United States Patent 7,034,007 (LOW ADENOSINE ANTI-SENSE OLIGONUCLEOTIDE, COMPOSITIONS, KIT & METHOD FOR TREATMENT OF AIRWAY DISORDERS ASSOCIATED WITH BRONCHOCONSTRICTION, LUNG INFLAMMATION, ALLERGY(IES) & SURFACTANT DEPLETION) - sequence listing, part 2

SEQ ID NO: 2658 - DNA, 6210 bp; single-stranded, linear
gcaggaacagtgctagtattgctcgagcccgagggctggaggttaggggatgaaggtctgcttccacgctttgcactgaattagggctagaattggggatgggggtaggggcgcattccttcgggagccgaggcttaagtcctcggggtcctgtactcgatgccgtttctcctatctctgagcctcagaactgtcttcagtttccgtacaagggtaaaaaggcgctctctgccccatcccccccgacctcgggaacaagggtccgcattgaaccaggtgcgaatgttctctctcattctgcgccgttcccgcctcccctcccccagccgcggcccccgcctccccccgcactgcaccctcggtgttggctgcagcccgcgagcagttcccgtcaatccctccccccttacacaggatgtccatattaggacatctgcgtcagcaggtttccacggcctttccctgtagccctggggggagccatccccgaaacccctcatcttggggggcccacgagacctctgagacaggaactgcgaaatgctcacgagattaggacacgcgccaaggcgggggcagggagctgcgagcgctggggacgcagccgggcggccgcagaagcgcccaggcccgcgcgccacccctctggcgccaccgtggttgagcccgtgacgtttacactcattcataaaacgcttgttataaaagcagtggctgcggcgcctcgtactccaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttcttcggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctattctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaagggaaagttggagattgagcataagggcccttgagtaagactgtgtcttatgctttcctttatccctctgtatacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaccaaccttgtgctcttttcattctggaagtcttgtaagtttctgaaaggtattattggagaccagtttgtcaagaagggtagctgctggagggggacacaccctctgtctgatcccttatcaaagaggacaaggaaactatagagctgattttagaatattttacaaatacatgccttccattggaatgctaagattttctactgcttctggggacgggaaaccgctgtgtaacagcttttgtgggaatacattttttctgtttcagtactcgcagggggaaatatttaaattttgttgtgctaatattaaattcagatgttttgatcttaaaggaaccctttaagcaaacagaacctagctttgtacagactattttaactttttattctcacaaaatcacgtggagggttattctacttcaaagatgagcaaattgaagaatggttagaataaacaactttcttgatattccgttatcggcattagaatcttcctgctcgttatcgtatccagcaggctgaactgcctcttgatacttggttaaaaaaaattttcaggccgggcgcggtggcccatgcctgtaatcctagcactttgggaggccgaggcaggcggatcacctgaggtcgggagttcgagaccagcctgaccaacatggagaaaccccgtctttactaaaaatacaaaattagcctggtgtggtggtgcatgcctgtaatcctagctacttgagaggctgagacaggaaaatcacttgaactcgggaggcggatgttgcagcgaactgagattgcgccattgcactccagcctgggcaacaagattgaaactctgtttaaaaaaaaaagttttcactaatgtgtacatttttttgtactcttttattctcgaaagggaaggagggctattgccctatcccttattaataaatgcattgtggtttctggtttctctaataccatatgcccttcattcagtttatagtgggcggaagtgggggagaaaaagttgctcagaaatcaaaagatatctcaaacagcacaaataatggctgatcgttctgcaaacaaaaagttacataatagctcaagaaggagaagtcaacatgactctgaacaagctttaacttagaaactttatcatcttaaggaagaacgtgacctttgtccaggacgtctctggtaatggggcacttacacacacatgcacacgtacaaaccacagggaaaggagaccgcccttctgcctctgctcgcgagtatcacgcaggcaccatgcactatgttttcacacacactgggtggaagaagagcttcagcgccagtcttctaatgctttggtgataatgaaaatcactgggtgcttatggggtgtcatattcaatcgagttaaaagttttaattcaaaatgacagttttactgaggttgatgttctcgtctatgatatctctgcccctcccataaaaatggacatttaaaagcaacttaccgctctttagatcactcctatatcacacaccacttggggtgctgtttctgctagacttgtgatgacagtggccttaggatccctgtttgctgttcaaagggcaaatattttatagcctttaaatatacctaaactaaatacagaattaatataactaacaaacacctggtctgaaataacaaggtgatctaccctggaaggaacccagctggtgggccaggagcggtggctcacacctgtaattccagcactttgggaggctgagacaggaggatcactggagtccaggagtttgagaccagcctgggcaacatggcaaaacccagtgtgcttctgttgtcccagctacactactcaggaggctgaggcaggagtatgacttgagcctgggagggggaggttgcagagaactgatattgcaccaccactgcactccagcctgggtgacacagcaaaaccctatctcaaaaaaaaaaaaaaaaaaaaggaacccagctggttcctgtaggtgtgcaataataacaaccagaggaagaaaaggaagacgatttcccagatgaagaagggcagctggaccttcggac

SEQ ID NO: 2659 - DNA, 3565 bp; single-stranded, linear
gcagccgggcggccgcagaagcgcccaggcccgcgcgccacccctctggcgccaccgtggttgagcccgtgacgtttacactcattcataaaacgcttgttataaaagcagtggctgcggcgcctcgtactccaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttcttcggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctattctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaagggaaagttggagattgagcataagggcccttgagtaagactgtgtcttatgctttcctttatccctctgtatacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaccaaccttgtgctcttttcattctggaagt

SEQ ID NO: 2660 - DNA, 3198 bp; single-stranded, linear
cctcgaggtcgaagcttatttaaaagcatattttccaatgcctgctttagctgtggaaaaggaagactctccgagggcaaatccaggagtcatggaaaacaatgggcagggcagcttggtgctgtgactggatgggtctttaaggttgtttcccttgaataaagaatgagggaattccaccaggggaaggagagtagaccaaacatttggtgaacagaaagggagacagagtctttagtgttattccccaaatattcctggagagncctttgagacacctggtaggattatagtgatctaaagaggcatggccatgtgactgcttnggccaatgatgtatgggcagaagtgatgtgtgccataagtggatgctctgacagacatgatgttccgagttccttccccacagncaggatagctgtgaaaaggggtatcaacacgaggcctccttcagcctgagccctttagtgactacaatgagcagagctaccctgccaacctacaacggtcatgtagnagaaatgaccaactttcactggaataagncactgatatgttagggttgnntggtagggcagcataacactnnctntcctgacagaactgggagtgagagataaggctggagagagaaggagttggattgtgaaaanccccttctccaaggcataggaatcggaactctcctgattgtaaggaaaagccaatgaaggcttccaagcaggggcgttaacatgaacagatttgttatttttttggatgaaatatgctatttctcaacataaggagaagatcagcctactaaaccacatgaggcagagaggaacacacagaaccttagccaaaagatatatatttatgcaaagtcctaagtcttgaaatttctaaatacaggagctctgaacggagttacagtcagaggatcaggcaagaaaatttcttctatgccacaagcgctatttcctctgcagataactaatactccacaagaaagtttgccagagtagagaaaatacaaaggaatgtaacacagacctgaggtcaatttccagctgcctgtgtgacctcaacaaagatacttaacctctctgggcctatttcctcacatgttaaatctggataataatatatgtctctcaagacagttgtggggagaaaacagcgtatttaaattgcttaggagaatgcctggcagataataagtgtttaatacatgaaactgatttttattactgttattaaaaaatatttagaacaccaactccctgaatacaacagaaaatgattcagggcaacagacagaggagaatgttctctccttgaggaagcaactggatcttgtcatcactgtatacctacctaccccaccccctccccagctcagtgcctggctcacagtaggctttcagttaccctctgcagatcagtgaaagctaggtgagtgcccggagtgaagaaaagttggcaggtttcccactgataccagctgctgttggtttctgaacactcaaagccgcaaataccttagggctgggggcaatgaacccaaggctgaattccaagttcagaagcagcgaagtctgaatttagaacctaggacttaaactgctgcaggtccaacttcaagccccagttttagacagaggcttgggaaagatctgacttctaacccggttccccctcccctcctcccctcgatgcttctcacaggaaagtacacctggtcctgccaaatcgcactcttatatcctggcatcctatccaggctctgcgaggatggaaactgcgaggcaggggagggaagcgggctgtttggccaccacctccctagtgctgcaggcgaccctgtcacactaaactcctggcagcccagtgaggtggacggcaccgccccacctgcagatgagggaaatgaagctcggaggagttccgtgatttgcttgcttcacactgtggtagcctggccacgaaagaaccaaggattccgacttcggattcttccaccacacactttcgtcctaagggtgggggcggggggagaataaaataaccgcggaaaaggaaccacttacatgtgtctagcgcttcctagaggctacccaggatatgcgcccaccacccggccggagtgcagagatttgaagtccaggttctaccccgggctccgagtactactgcgtgactttatgcgagtgtcgccgccttctgggcttgttttcccggaagcaactcggcgcggatggagtgtgtgtgtgcgcgcgcgcgttatgttgtgcgtgttgtgttagcgtgtgcgtgttgtccgagtttcggatcgcctacacctgtgaacccccgcgccctttcccccacggtcccggagatgaagtggggtgcaacggagactcagctgagcgtccagtttcgggcaatacaaatctctcggcttctacgagcagccacacgaccccgcggaccgtcgctcctgaacttgaccgagatgcaaacttcggagtgttctcaacgtgggggccgactctcggagaccgccctaaacttaagtccccttaggctcgccccacctggacttcacatagccaccttaagggcggtattcccgcccccggaagtgcgggtggcagcgtacttggattctcagcctccagccccgcgcggtggcggccgcggtggatgacttcgggccccacaagtggaaacaacaaccacccctcgcccgcacccctggcccaaaacaactggccaggttccctcgtcccgggtccctgcatcccccgcatccccgtccgcagccgtgaacttgagcccccctccatcagaggttgcgagcgtcgccgctcggcagccaccgtcactagacagtcaaaccccaagacgtcagcccacaatgcaccgggcgggccgggaaaaacggcccggggaggggaccggggaacagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctca

SEQ ID NO: 2661 - DNA, 3622 bp; single-stranded, linear
cccggggaggggaccggggaacagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtggttcgggagtgtccagagagccttgtctccagccggccccgggaggagagccctgctgcccaggcgctgttgacagcggcggaaagcagcggtaccccacgcgcccgccgggggacgtcggcgagcggctgcagcagcaaagaactttcccggcggggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcacgccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggaggggttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttcggtctgacggcgcccccagtgtgcacgagtgggaaggacttggtcgcgccctcccttggcgtggagccagggagcggccgcctgcgggctgccccgctttgcggacgggctgtccccgcgcgaacggaacgttggactttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgctttcgttaactgtgtatgtacatatatatattttttaatttgattaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatcctagtctatctaggtggagttgaaagagttaagaatgctcgataaaatcactctcagtgcttcttactattaagcagtaaaaactgttctctattagacttagaaataaatgtacctgatgtacctgatgctatgtcaggcttcatactccacgctcccccagcgtatctatatggaattgcttaccaaaggctagtgcgatgtttcaggaggctggaggaaggggggttgcagtggagagggacagcccactgagaagtcaaacatttcaaagtttggattgcatcaagtggcatgtgctgtgaccatttataatgttagaaattttacaataggtgcttattctcaaagcaggaattggtggcagattttacaaaagatgtatccttccaatttggaatcttctctttgacaattcctagataaaaagatggcctttgtcttatgaatatttataacagcattctgtcacaataaatgtattcaaataccaataacagatcttgaattgcttccctttactacttttttgttcccaagttatatactgaagtttttatttttagttgctgaggtt

SEQ ID NO: 2662 - DNA, 16595 bp; single-stranded, linear
gcaggaacagtgctagtattgctcgagcccgagggctggaggttaggggatgaaggtctgcttccacgctttgcactgaattagggctagaattggggatgggggtaggggcgcattccttcgggagccgaggcttaagtcctcggggtcctgtactcgatgccgtttctcctatctctgagcctcagaactgtcttcagtttccgtacaagggtaaaaaggcgctctctgccccatcccccccgacctcgggaacaagggtccgcattgaaccaggtgcgaatgttctctctcattctgcgccgttcccgcctcccctcccccagccgcggcccccgcctccccccgcactgcaccctcggtgttggctgcagcccgcgagcagttcccgtcaatccctccccccttacacaggatgtccatattaggacatctgcgtcagcaggtttccacggcctttccctgtagccctggggggagccatccccgaaacccctcatcttggggggcccacgagacctctgagacaggaactgcgaaatgctcacgagattaggacacgcgccaaggcgggggcagggagctgcgagcgctggggacgcagccgggcggccgcagaagcgcccaggcccgcgcgccacccctctggcgccaccgtggttgagcccgtgacgtttacactcattcataaaacgcttgttataaaagcagtggctgcggcgcctcgtactccaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttcttcggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctattctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaagggaaagttggagattgagcataagggcccttgagtaagactgtgtcttatgctttcctttatccctctgtatacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaccaaccttgtgctcttttcattctggaagtcttgtaagtttctgaaaggtattattggagaccagtttgtcaagaagggtagctgctggagggggacacaccctctgtctgatcccttatcaaagaggacaaggaaactatagagctgattttagaatattttacaaatacatgccttccattggaatgctaagattttctactgcttctggggacgggaaaccgctgtgtaacagcttttgtgggaatacattttttctgtttcagtactcgcagggggaaatatttaaattttgttgtgctaatattaaattcagatgttttgatcttaaaggaaccctttaagcaaacagaacctagctttgtacagactattttaactttttattctcacaaaatcacgtggagggttattctacttcaaagatgagcaaattgaagaatggttagaataaacaactttcttgatattccgttatcggcattagaatcttcctgctcgttatcgtatccagcaggctgaactgcctcttgatacttggttaaaaaaaattttcaggccgggcgcggtggcccatgcctgtaatcctagcactttgggaggccgaggcaggcggatcacctgaggtcgggagttcgagaccagcctgaccaacatggagaaaccccgtctttactaaaaatacaaaattagcctggtgtggtggtgcatgcctgtaatcctagctacttgagaggctgagacaggaaaatcacttgaactcgggaggcggatgttgcagcgaactgagattgcgccattgcactccagcctgggcaacaagattgaaactctgtttaaaaaaaaaagttttcactaatgtgtacatttttttgtactcttttattctcgaaagggaaggagggctattgccctatcccttattaataaatgcattgtggtttctggtttctctaataccatatgcccttcattcagtttatagtgggcggaagtgggggagaaaaagttgctcagaaatcaaaagatatctcaaacagcacaaataatggctgatcgttctgcaaacaaaaagttacataatagctcaagaaggagaagtcaacatgactctgaacaagctttaacttagaaactttatcatcttaaggaagaacgtgacctttgtccaggacgtctctggtaatggggcacttacacacacatgcacacgtacaaaccacagggaaaggagaccgcccttctgcctctgctcgcgagtatcacgcaggcaccatgcactatgttttcacacacactgggtggaagaagagcttcagcgccagtcttctaatgctttggtgataatgaaaatcactgggtgcttatggggtgtcatattcaatcgagttaaaagttttaattcaaaatgacagttttactgaggttgatgttctcgtctatgatatctctgcccctcccataaaaatggacatttaaaagcaacttaccgctctttagatcactcctatatcacacaccacttggggtgctgtttctgctagacttgtgatgacagtggccttaggatccctgtttgctgttcaaagggcaaatattttatagcctttaaatatacctaaactaaatacagaattaatataactaacaaacacctggtctgaaataacaaggtgatctaccctggaaggaacccagctggtgggccaggagcggtggctcacacctgtaattccagcactttgggaggctgagacaggaggatcactggagtccaggagtttgagaccagcctgggcaacatggcaaaacccagtgtgcttctgttgtcccagctacactactcaggaggctgaggcaggagtatgacttgagcctgggagggggaggttgcagagaactgatattgcaccaccactgcactccagcctgggtgacacagcaaaaccctatctcaaaaaaaaaaaaaaaaaaaaggaacccagctggttcctgtaggtgtgcaataataacaaccagaggaagaaaaggaagacgatttcccagatgaagaagggcagctggaccttcggacgcagccgggcggccgcagaagcgcccaggcccgcgcgccacccctctggcgccaccgtggttgagcccgtgacgtttacactcattcataaaacgcttgttataaaagcagtggctgcggcgcctcgtactccaaccgcatctgcagcgagcaactgagaagccaagactgagccggcggccgcggcgcagcgaacgagcagtgaccgtgctcctacccagctctgcttcacagcgcccacctgtctccgcccctcggcccctcgcccggctttgcctaaccgccacgatgatgttctcgggcttcaacgcagactacgaggcgtcatcctcccgctgcagcagcgcgtccccggccggggatagcctctcttactaccactcacccgcagactccttctccagcatgggctcgcctgtcaacgcgcaggtaaggctggcttcccgtcgccgcggggccgggggcttggggtcgcggaggaggagacaccgggcgggacgctccagtagatgagtagggggctcccttgtgcctggagggaggctgccgtggccggagcggtgccggctcgggggctcgggacttgctctgagcgcacgcacgcttgccatagtaagaattggttcccccttcgggaggcaggttcgttctgagcaacctctggtctgcactccaggacggatctctgacattagctggagcagacgtgtcccaagcacaaactcgctaactagagcctggcttcttcggggaggtggcagaaagcggcaatcccccctcccccggcagcctggagcacggaggagggatgagggaggagggtgcagcgggcgggtgtgtaaggcagtttcattgataaaaagcgagttcattctggagactccggagcggcgcctgcgtcagcgcagacgtcagggatatttataacaaaccccctttcaagcaagtgatgctgaagggataacgggaacgcagcggcaggatggaagagacaggcactgcgctgcggaatgcctgggaggaaaagggggagacctttcatccaggatgagggacatttaagatgaaatgtccgtggcaggatcgtttctcttcactgctgcatgcggcactgggaactcgccccacctgtgtccggaacctgctcgctcacgtcggctttccccttctgttttgttctaggacttctgcacggacctggccgtctccagtgccaacttcattcccacggtcactgccatctcgaccagtccggacctgcagtggctggtgcagcccgccctcgtctcctctgtggccccatcgcagaccagagcccctcaccctttcggagtccccgccccctccgctggggcttactccagggctggcgttgtgaagaccatgacaggaggccgagcgcagagcattggcaggaggggcaaggtggaacaggtgaggaactctagcgtactcttcctgggaatgtgggggctgggtgggaagcagccccggagatgcaggagcccagtacagaggatgaagccactgatggggctggctgcacatccgtaactgggagccctggctccaagcccattccatcccaactcagactctgagtctcaccctaagaagtactctcatagtttcttccctaagtttcttaccgcatgctttcagactgggctcttctttgttctcttgctgaggatcttattttaaatgcaagtcacacctattctgcaactgcaggtcagaaatggtttcacagtggggtgccaggaagcagggaagctgcaggagccagttctactggggtgggtgaatggaggtgatggcagacacttttactgaatgtcggtctttttttgtgattattctagttatctccagaagaagaagagaaaaggagaatccgaagggaaaggaataagatggctgcagccaaatgccgcaaccggaggagggagctgactgatacactccaagcggtaggtactctgtgggttgctcctttttaaaacttaagggaaagttggagattgagcataagggcccttgagtaagactgtgtcttatgctttcctttatccctctgtatacaggagacagaccaactagaagatgagaagtctgctttgcagaccgagattgccaacctgctgaaggagaaggaaaaactagagttcatcctggcagctcaccgacctgcctgcaagatccctgatgacctgggcttcccagaagagatgtctgtggcttcccttgatctgactgggggcctgccagaggttgccaccccggagtctgaggaggccttcaccctgcctctcctcaatgaccctgagcccaagccctcagtggaacctgtcaagagcatcagcagcatggagctgaagaccgagccctttgatgacttcctgttcccagcatcatccaggcccagtggctctgagacagcccgctccgtgccagacatggacctatctgggtccttctatgcagcagactgggagcctctgcacagtggctccctggggatggggcccatggccacagagctggagcccctgtgcactccggtggtcacctgtactcccagctgcactgcttacacgtcttccttcgtcttcacctaccccgaggctgactccttccccagctgtgcagctgcccaccgcaagggcagcagcagcaatgagccttcctctgactcgctcagctcacccacgctgctggccctgtgagggggcagggaaggggaggcagccggcacccacaagtgccactgcccgagctggtgcattacagagaggagaaacacatcttccctagagggttcctgtagacctagggaggaccttatctgtgcgtgaaacacaccaggctgtgggcctcaaggacttgaaagcatccatgtgtggactcaagtccttacctcttccggagatgtagcaaaacgcatggagtgtgtattgttcccagtgacacttcagagagctggtagttagtagcatgttgagccaggcctgggtctgtgtctcttttctctttctccttagtcttctcatagcattaactaatctattgggttcattattggaattaacctggtgctggatattttcaaattgtatctagtgcagctgattttaacaataactactgtgttcctggcaatagtgtgttctgattagaaatgaccaatattatactaagaaaagatacgactttattttctggtagatagaaataaatagctatatccatgtactgtagtttttcttcaacatcaatgttcattgtaatgttactgatcatgcattgttgaggtggtctgaatgttctgacattaacagttttccatgaaaacgttttattgtgtttttaatttatttattaagatggattctcagatatttatatttttattttatttttttctaccttgaggtcttttgacatgtggaaagtgaatttgaatgaaaaatttaagcattgtttgcttattgttccaagacattgtcaataaaagcatttaagttgaatgcgaccaaccttgtgctcttttcattctggaagtcctcgaggtcgaagcttatttaaaagcatattttccaatgcctgctttagctgtggaaaaggaagactctccgagggcaaatccaggagtcatggaaaacaatgggcagggcagcttggtgctgtgactggatgggtctttaaggttgtttcccttgaataaagaatgagggaattccaccaggggaaggagagtagaccaaacatttggtgaacagaaagggagacagagtctttagtgttattccccaaatattcctggagagncctttgagacacctggtaggattatagtgatctaaagaggcatggccatgtgactgcttnggccaatgatgtatgggcagaagtgatgtgtgccataagtggatgctctgacagacatgatgttccgagttccttccccacagncaggatagctgtgaaaaggggtatcaacacgaggcctccttcagcctgagccctttagtgactacaatgagcagagctaccctgccaacctacaacggtcatgtagnagaaatgaccaactttcactggaataagncactgatatgttagggttgnntggtagggcagcataacactnnctntcctgacagaactgggagtgagagataaggctggagagagaaggagttggattgtgaaaanccccttctccaaggcataggaatcggaactctcctgattgtaaggaaaagccaatgaaggcttccaagcaggggcgttaacatgaacagatttgttatttttttggatgaaatatgctatttctcaacataaggagaagatcagcctactaaaccacatgaggcagagaggaacacacagaaccttagccaaaagatatatatttatgcaaagtcctaagtcttgaaatttctaaatacaggagctctgaacggagttacagtcagaggatcaggcaagaaaatttcttctatgccacaagcgctatttcctctgcagataactaatactccacaagaaagtttgccagagtagagaaaatacaaaggaatgtaacacagacctgaggtcaatttccagctgcctgtgtgacctcaacaaagatacttaacctctctgggcctatttcctcacatgttaaatctggataataatatatgtctctcaagacagttgtggggagaaaacagcgtatttaaattgcttaggagaatgcctggcagataataagtgtttaatacatgaaactgatttttattactgttattaaaaaatatttagaacaccaactccctgaatacaacagaaaatgattcagggcaacagacagaggagaatgttctctccttgaggaagcaactggatcttgtcatcactgtatacctacctaccccaccccctccccagctcagtgcctggctcacagtaggctttcagttaccctctgcagatcagtgaaagctaggtgagtgcccggagtgaagaaaagttggcaggtttcccactgataccagctgctgttggtttctgaacactcaaagccgcaaataccttagggctgggggcaatgaacccaaggctgaattccaagttcagaagcagcgaagtctgaatttagaacctaggacttaaactgctgcaggtccaacttcaagccccagttttagacagaggcttgggaaagatctgacttctaacccggttccccctcccctcctcccctcgatgcttctcacaggaaagtacacctggtcctgccaaatcgcactcttatatcctggcatcctatccaggctctgcgaggatggaaactgcgaggcaggggagggaagcgggctgtttggccaccacctccctagtgctgcaggcgaccctgtcacactaaactcctggcagcccagtgaggtggacggcaccgccccacctgcagatgagggaaatgaagctcggaggagttccgtgatttgcttgcttcacactgtggtagcctggccacgaaagaaccaaggattccgacttcggattcttccaccacacactttcgtcctaagggtgggggcggggggagaataaaataaccgcggaaaaggaaccacttacatgtgtctagcgcttcctagaggctacccaggatatgcgcccaccacccggccggagtgcagagatttgaagtccaggttctaccccgggctccgagtactactgcgtgactttatgcgagtgtcgccgccttctgggcttgttttcccggaagcaactcggcgcggatggagtgtgtgtgtgcgcgcgcgcgttatgttgtgcgtgttgtgttagcgtgtgcgtgttgtccgagtttcggatcgcctacacctgtgaacccccgcgccctttcccccacggtcccggagatgaagtggggtgcaacggagactcagctgagcgtccagtttcgggcaatacaaatctctcggcttctacgagcagccacacgaccccgcggaccgtcgctcctgaacttgaccgagatgcaaacttcggagtgttctcaacgtgggggccgactctcggagaccgccctaaacttaagtccccttaggctcgccccacctggacttcacatagccaccttaagggcggtattcccgcccccggaagtgcgggtggcagcgtacttggattctcagcctccagccccgcgcggtggcggccgcggtggatgacttcgggccccacaagtggaaacaacaaccacccctcgcccgcacccctggcccaaaacaactggccaggttccctcgtcccgggtccctgcatcccccgcatccccgtccgcagccgtgaacttgagcccccctccatcagaggttgcgagcgtcgccgctcggcagccaccgtcactagacagtcaaaccccaagacgtcagcccacaatgcaccgggcgggccgggaaaaacggcccggggaggggaccggggaacagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcacccggggaggggaccggggaacagagggccgagaggcgtgcggcaggggggagggtaggagaaagaagggcccgactgtaggagggcagcggagcattacctcatcccgtgagcctccgcgggcccagagaagaatcttctagggtggagtctccatggtgacgggcgggcccgcccccctgagagcgacgcgagccaatgggaaggccttggggtgacatcatgggctatttttaggggttgactggtagcagataagtgttgagctcgggctggataagggctcagagttgcactgagtgtggctgaagcagcgaggcgggagtggaggtgcgcggagtcaggcagacagacagacacagccagccagccaggtcggcagtatagtccgaactgcaaatcttattttcttttcaccttctctctaactgcccagagctagcgcctgtggctcccgggctggtggttcgggagtgtccagagagccttgtctccagccggccccgggaggagagccctgctgcccaggcgctgttgacagcggcggaaagcagcggtaccccacgcgcccgccgggggacgtcggcgagcggctgcagcagcaaagaactttcccggcggggaggaccggagacaagtggcagagtcccggagcgaacttttgcaagcctttcctgcgtcttaggcttctccacggcggtaaagaccagaaggcggcggagagccacgcaagagaagaaggacgtgcgctcagcttcgctcgcaccggttgttgaacttgggcgagcgcgagccgcggctgccgggcgccccctccccctagcagcggaggaggggacaagtcgtcggagtccgggcggccaagacccgccgccggccggccactgcagggtccgcactgatccgctccgcggggagagccgctgctctgggaagtgagttcgcctgcggactccgaggaaccgctgcgcccgaagagcgctcagtgagtgaccgcgacttttcaaagccgggtagcgcgcgcgagtcgacaagtaagagtgcgggaggcatcttaattaaccctgcgctccctggagcgagctggtgaggagggcgcagcggggacgacagccagcgggtgcgtgcgctcttagagaaactttccctgtcaaaggctccggggggcgcgggtgtcccccgcttgccagagccctgttgcggccccgaaacttgtgcgcgcacgccaaactaacctcacgtgaagtgacggactgttctatgactgcaaagatggaaacgaccttctatgacgatgccctcaacgcctcgttcctcccgtccgagagcggaccttatggctacagtaaccccaagatcctgaaacagagcatgaccctgaacctggccgacccagtggggagcctgaagccgcacctccgcgccaagaactcggacctcctcacctcgcccgacgtggggctgctcaagctggcgtcgcccgagctggagcgcctgataatccagtccagcaacgggcacatcaccaccacgccgacccccacccagttcctgtgccccaagaacgtgacagatgagcaggaggggttcgccgagggcttcgtgcgcgccctggccgaactgcacagccagaacacgctgcccagcgtcacgtcggcggcgcagccggtcaacggggcaggcatggtggctcccgcggtagcctcggtggcagggggcagcggcagcggcggcttcagcgccagcctgcacagcgagccgccggtctacgcaaacctcagcaacttcaacccaggcgcgctgagcagcggcggcggggcgccctcctacggcgcggccggcctggcctttcccgcgcaaccccagcagcagcagcagccgccgcaccacctgccccagcagatgcccgtgcagcacccgcggctgcaggccctgaaggaggagcctcagacagtgcccgagatgcccggcgagacaccgcccctgtcccccatcgacatggagtcccaggagcggatcaaggcggagaggaagcgcatgaggaaccgcatcgctgcctccaagtgccgaaaaaggaagctggagagaatcgcccggctggaggaaaaagtgaaaaccttgaaagctcagaactcggagctggcgtccacggccaacatgctcagggaacaggtggcacagcttaaacagaaagtcatgaaccacgttaacagtgggtgccaactcatgctaacgcagcagttgcaaacattttgaagagagaccgtcgggggctgaggggcaacgaagaaaaaaaataacacagagagacagacttgagaacttgacaagttgcgacggagagaaaaaagaagtgtccgagaactaaagccaagggtatccaagttggactgggttcggtctgacggcgcccccagtgtgcacgagtgggaaggacttggtcgcgccctcccttggcgtggagccagggagcggccgcctgcgggctgccccgctttgcggacgggctgtccccgcgcgaacggaacgttggactttcgttaacattgaccaagaactgcatggacctaacattcgatctcattcagtattaaaggggggagggggagggggttacaaactgcaatagagactgtagattgcttctgtagtactccttaagaacacaaagcggggggagggttggggaggggcggcaggagggaggtttgtgagagcgaggctgagcctacagatgaactctttctggcctgctttcgttaactgtgtatgtacatatatatattttttaatttgattaaagctgattactgtcaataaacagcttcatgcctttgtaagttatttcttgtttgtttgtttgggtatcctgcccagtgttgtttgtaaataagagatttggagcactctgagtttaccatttgtaataaagtatataatttttttatgttttgtttctgaaaattccagaaaggatatttaagaaaatacaataaactattggaaagtactcccctaacctcttttctgcatcatctgtagatcctagtctatctaggtggagttgaaagagttaagaatgctcgataaaatcactctcagtgcttcttactattaagcagtaaaaactgttctctattagacttagaaataaatgtacctgatgtacctgatgctatgtcaggcttcatactccacgctcccccagcgtatctatatggaattgcttaccaaaggctagtgcgatgtttcaggaggctggaggaaggggggttgcagtggagagggacagcccactgagaagtcaaacatttcaaagtttggattgcatcaagtggcatgtgctgtgaccatttataatgttagaaattttacaataggtgcttattctcaaagcaggaattggtggcagattttacaaaagatgtatccttccaatttggaatcttctctttgacaattcctagataaaaagatggcctttgtcttatgaatatttataacagcattctgtcacaataaatgtattcaaataccaataacagatcttgaattgcttccctttactacttttttgttcccaagttatatactgaagtttttatttttagttgctgaggtt

SEQ ID NO: 2663 - DNA, 6757 bp; single-stranded, linear
cggccccagaaaacccgagcgagtagggggcggcgcgcaggagggaggagaactgggggcgcgggaggctggtgggtgtcgggggtggagatgtagaagatgtgacgccgcggcccggcgggtgccagattagcggacggctgcccgcggttgcaacgggatcccgggcgctgcagcttgggaggcggctctccccaggcggcgtccgcggagacacccatccgtgaaccccaggtcccgggccgccggctcgccgcgcaccaggggccggcggacagaagagcggccgagcggctcgaggctgggggaccgcgggcgcggccgcgcgctgccgggcgggaggctggggggccggggccggggccgtgccccggagcgggtcggaggccggggccggggccgggggacggcggctccccgcgcggctccagcggctcggggatcccggccgggccccgcagggaccatggcagccgggagcatcaccacgctgcccgccttgcccgaggatggcggcagcggcgccttcccgcccggccacttcaaggaccccaagcggctgtactgcaaaaacgggggcttcttcctgcgcatccaccccgacggccgagttgacggggtccgggagaagagcgaccctcacatcaagctacaacttcaagcagaagagagaggagttgtgtctatcaaaggagtgtgtgctaaccgttacctggctatgaaggaagatggaagattactggcttctaaatgtgttacggatgagtgtttcttttttgaacgattggaatctaataactacaatacttaccggtcaaggaaatacaccagttggtatgtggcactgaaacgaactgggcagtataaacttggatccaaaacaggacctgggcagaaagctatactttttcttccaatgtctgctaagagctgattttaatggccacatctaatctcatttcacatgaaagaagaagtatattttagaaatttgttaatgagagtaaaagaaaataaatgtgtatagctcagtttggataattggtcaaacaattttttatccagtagtaaaatatgtaaccattgtcccagtaaagaaaaataacaaaagttgtaaaatgtatattctcccttttatattgcatctgctgttacccagtgaagcttacctagagcaatgatctttttcacgcatttgctttattcgaaaagaggcttttaaaatgtgcatgtttagaaacaaaatttcttcatggaaatcatatacattagaaaatcacagtcagatgtttaatcaatccaaaatgtccactatttcttatgtcattcgttagtctacatgtttctaaacatataaatgtgaatttaatcaattcctttcatagttttataattctctggcagttccttatgatagagtttataaaacagtcctgtgtaaactgctggaagttcttccacagtcaggtcaattttgtcaaacccttctctgtacccatacagcagcagcctagcaactctgctggtgatgggagttgtattttcagtcttcgccaggtcattgagatccatccactcacatcttaagcattcttcctggcaaaaatttatggtgaatgaatatggctttaggcggcagatgatatacatatctgacttcccaaaagctccaggatttgtgtgctgttgccgaatactcaggacggacctgaattctgattttataccagtctcttcaaaaacttctcgaaccgctgtgtctcctacgtaaaaaaagagatgtacaaatcaataataattacacttttagaaactgtatcatcaaagattttcagttaaagtagcattatgtaaaggctcaaaacattaccctaacaaagtaaagttttcaatacaaattctttgccttgtggatatcaagaaatcccaaaatattttcttaccactgtaaattcaagaagcttttgaaatgctgaatatttctttggctgctacttggaggcttatctacctgtacatttttggggtcagctctttttaacttcttgctgctctttttcccaaaaggtaaaaatatagattgaaaagttaaaacattttgcatggctgcagttcctttgtttcttgagataagattccaaagaacttagattcatttcttcaacaccgaaatgctggaggtgtttgatcagttttcaagaaacttggaatataaataattttataattcaacaaaggttttcacattttataaggttgatttttcaattaaatgcaaatttgtgtggcaggatttttattgccattaacatatttttgtggctgctttttctacacatccagatggtccctctaactgggctttctctaattttgtgatgttctgtcattgtctcccaaagtatttaggagaagccctttaaaaagctgccttcctctaccactttgctggaaagcttcacaattgtcacagacaaagatttttgttccaatactcgttttgcctctatttttcttgtttgtcaaatagtaaatgatatttgcccttgcagtaattctactggtgaaaaacatgcaaagaagaggaagtcacagaaacatgtctcaattcccatgtgctgtgactgtagactgtcttaccatagactgtcttacccatcccctggatatgctcttgttttttccctctaatagctatggaaagatgcatagaaagagtataatgttttaaaacataaggcattcatctgccatttttcaattacatgctgacttcccttacaattgagatttgcccataggttaaacatggttagaaacaactgaaagcataaaagaaaaatctaggccgggtgcagtggctcatgcctatattccctgcactttgggaggccaaagcaggaggatcgcttgagcccaggagttcaagaccaacctggtgaaaccccgtctctacaaaaaaacacaaaaaatagccaggcatggtggcgtgtacatgtggtctcagatacttgggaggctgaggtgggagggttgatcacttgaggctgagaggtcaaggttgcagtgagccataatcgtgccactgcagtccagcctaggcaacagagtgagactttgtctcaaaaaaagagaaattttccttaataagaaaagtaatttttactctgatgtgcaatacatttgttattaaatttattatttaagatggtagcactagtcttaaattgtataaaatatcccctaacatgtttaaatgtccatttttattcattatgctttgaaaaataattatggggaaatacatgtttgttattaaatttattattaaagatagtagcactagtcttaaatttgatataacatctcctaacttgtttaaatgtccatttttattctttatgcttgaaaataaattatggggatcctatttagctcttagtaccactaatcaaaagttcggcatgtagctcatgatctatgctgtttctatgtcgtggaagcaccggatgggggtagtgagcaaatctgccctgctcagcagtcaccatagcagctgactgaaaatcagcactgcctgagtagttttgatcagtttaacttgaatcactaactgactgaaaattgaatgggcaaataagtgcttttgtctccagagtatgcgggagacccttccacctcaagatggatatttcttccccaaggatttcaagatgaattgaaatttttaatcaagatagtgtgctttattctgttgtattttttattattttaatatactgtaagccaaactgaaataacatttgctgttttataggtttgaagaacataggaaaaactaagaggttttgtttttatttttgctgatgaagagatatgtttaaatatgttgtattgttttgtttagttacaggacaataatgaaatggagtttatatttgttatttctattttgttatatttaataatagaattagattgaaataaaatataatgggaaataatctgcagaatgtgggtttcctggtgtttcctctgactctagtgcactgatgatctctgataaggctcagctgctttatagttctctggctaatgcagcagatactcttcctgccagtggtaatacgattttttaagaaggcagtttgtcaattttaatcttgtggatacctttatactcttagggtattattttatacaaaagccttgaggattgcattctattttctatatgaccctcttgatatttaaaaaacactatggataacaattcttcatttacctagtattatgaaagaatgaaggagttcaaacaaatgtgtttcccagttaactagggtttactgtttgagccaatataaatgtttaactgtttgtgatggcagtattcctaaagtacattgcatgttttcctaaatacagagtttaaataatttcagtaattcttagatgattcagcttcatcattaagaatatcttttgttttatgttgagttagaaatgccttcatatagacatagtctttcagacctctactgtcagttttcatttctagctgctttcagggttttatgaattttcaggcaaagctttaatttatactaagcttaggaagtatggctaatgccaacggcagtttttttcttcttaattccacatgactgaggcatatatgatctctgggtaggtgagttgttgtgacaaccacaagcactttttttttttttaaagaaaaaaaggtagtgaatttttaatcatctggactttaagaaggattctggagtatacttaggcctgaaattatatatatttggcttggaaatgtgtttttcttcaattacatctacaagtaagtacagctgaaattcagaggacccataagagttcacatgaaaaaaatcaattcatttgaaaaggcaagatgcaggagagaggaagccttgcaaacctgcagactgctttttgcccaatatagattgggtaaggctgcaaaacataagcttaattagctcacatgctctgctctcacgtggcaccagtggatagtgtgagagaattaggctgtagaacaaatggccttctctttcagcattcacaccactacaaaatcatcttttatatcaacagaagaataagcataaactaagcaaaaggtcaataagtacctgaaaccaagattggctagagatatatcttaatgcaatccattttctgatggattgttacgagttggctatataatgtatgtatggtattttgatttgtgtaaaagttttaaaaatcaagctttaagtacatggacatttttaaataaaatatttaaagacaatttagaaaattgccttaatatcattgttggctaaatagaataggggacatgcatattaaggaaaaggtcatggagaaataatattggtatcaaacaaatacattgatttgtcatgatacacattgaatttgatccaatagtttaaggaataggtaggaaaatttggtttctatttttcgatttcctgtaaatcagtgacataaataattcttagcttattttatatttccttgtcttaaatactgagctcagtaagttgtgttaggggattatttctcagttgagactttcttatatgacattttactatgttttgacttcctgactattaaaaataaatagtagaaacaattttcataaagtgaagaattatataatcactgctttataactgactttattatatttatttcaaagttcatttaaaggctactattcatcctctgtgatggaatggtcaggaatttgttttctcatagtttaattccaacaacaatattagtcgtatccaaaataacctttaatgctaaactttactgatgtatatccaaagcttctccttttcagacagattaatccagaagcagtcataaacagaagaataggtggtatgttcctaatgatattatttctactaatggaataaactgtaatattagaaattatgctgctaattatatcagctctgaggtaatttctgaaatgttcagactcagtcggaacaaattggaaaatttaaatttttattcttagctataaagcaagaaagtaaacacattaatttcctcaacatttttaagccaattaaaaatataaaagatacacaccaatatcttcttcaggctctgacaggcctcctggaaacttccacatatttttcaactgcagtataaagtcagaaaataaagttaacataactttcactaacacacacatatgtagatttcacaaaatccacctataattggtcaaagtggttgagaatatattttttagtaattgcatgcaaaatttttctagcttccatcctttctccctcgtttcttctttttttgggggagctggtaactgatgaaatcttttcccaccttttctcttcaggaaatataagtggttttgtttggttaacgtgatacattctgtatgaatgaaacattggagggaaacatctactgaatttctgtaatttaaaatattttgctgctagttaactatgaacagatagaagaatcttacagatgctgctataaataagtagaaaatataaatttcatcactaaaatatgctattttaaaatctatttcctatattgtatttctaatcagatgtattactcttattatttctattgtatgtgttaatgattttatgtaaaaatgtaattgcttttcatgagtagtatgaataaaattgattagtttgtg

SEQ ID NO: 2664 - DNA, 1089 bp; single-stranded, linear
cagtgagctgtgattgcaccactgcaatttagcctgagtgacagaatgaaaaaaaaatttttttaaaggaaaacacaaaaagaatatgctgtcaacagggatgggaggaagaccacctttactgctatacacatttgtaccttttagatgttgatcaatatgaatatattatacacacagacacacacacagacacacacacacacacaaacaatacaatttaatatcctaagaggatattgacattagacaggtacaaaagctctagaaatgaggactttcctcagtgatgacttttttcaccaccaaagtcactcaggcatcctgacaagggtaagtgaggggagcctccttggaaaataaactcacttggatagtgaactcctgcacatacctcaaagcccatctgaaatgtcccctcctacaggaagttttccctgaccctccaagaagcagagttctatttcactggggaaaacatttcttcttcttcttttttttccctgccctgcacatgagctagaaaacatttcatgaaactgggagtttctgtgctgggctctgtccctcccccattctacttcccctccctcagcatggaagcctctggaagtggggctctgactcccagcctacagagagattcctaggaagtgttcgactgataaacgcatggccaaaagtgaactggggatgaggtccaagacatctgcggtggggggttctccagaccttagtgttcttccactacaaagtgggtccaacagagaaaggtctgtgttcaccaggtggccctgaccctgggagagtccagggcagggtgcagctgcattcatgctgctggggaacatgccctcaggttactcaccccatggacatgttggccccagggactgaaaagcttaggaaatggtattgagaaatctggggcagccccaaaaggggagaggccatggggagaagggggggctgagtgggggaaaggcaggagccagataaaaagccagctccagcaggcgctgctcactcctccccatcctctccctctgtccctctgtccctctgaccctgcactgtcccagcaccatg

SEQ ID NO: 2665 - DNA, 5947 bp; single-stranded, linear
tttctcccattctacttccctcctcagcattggaagctcgtaagtgggctctgactcccagcctacagagagattccttaagaagtggttcgactgataaacgcattgccaaaagtgaactgggatgaggtccaagacatctgcggtgggggttctccagaccttagtgttcttccactacaaagtgggtccaacagagaaaggtctgtgttcaccaggtggccctgaccctggagagtccagggcagggtgcagctgcattcatgctgctggggaacatgccctcaggttactcaccccatgacatgttggccccagggactgaaaagcttaggaaatggtattgagaaatctggggcagccaaaaggggagaggccatggggagaagggggggctgagtgggggaaagcaggagcgagataaaaagccagctccagcaggcgctgctcactcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacctccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtcagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgccgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattccatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagag

SEQ ID NO: 2666 - DNA, 5067 bp; single-stranded, linear
ctcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacctccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtcagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgccgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcc

SEQ ID NO: 2667 - DNA, 12103 bp; single-stranded, linear
cagtgagctgtgattgcaccactgcaatttagcctgagtgacagaatgaaaaaaaaatttttttaaaggaaaacacaaaaagaatatgctgtcaacagggatgggaggaagaccacctttactgctatacacatttgtaccttttagatgttgatcaatatgaatatattatacacacagacacacacacagacacacacacacacacaaacaatacaatttaatatcctaagaggatattgacattagacaggtacaaaagctctagaaatgaggactttcctcagtgatgacttttttcaccaccaaagtcactcaggcatcctgacaagggtaagtgaggggagcctccttggaaaataaactcacttggatagtgaactcctgcacatacctcaaagcccatctgaaatgtcccctcctacaggaagttttccctgaccctccaagaagcagagttctatttcactggggaaaacatttcttcttcttcttttttttccctgccctgcacatgagctagaaaacatttcatgaaactgggagtttctgtgctgggctctgtccctcccccattctacttcccctccctcagcatggaagcctctggaagtggggctctgactcccagcctacagagagattcctaggaagtgttcgactgataaacgcatggccaaaagtgaactggggatgaggtccaagacatctgcggtggggggttctccagaccttagtgttcttccactacaaagtgggtccaacagagaaaggtctgtgttcaccaggtggccctgaccctgggagagtccagggcagggtgcagctgcattcatgctgctggggaacatgccctcaggttactcaccccatggacatgttggccccagggactgaaaagcttaggaaatggtattgagaaatctggggcagccccaaaaggggagaggccatggggagaagggggggctgagtgggggaaaggcaggagccagataaaaagccagctccagcaggcgctgctcactcctccccatcctctccctctgtccctctgtccctctgaccctgcactgtcccagcaccatgtttctcccattctacttccctcctcagcattggaagctcgtaagtgggctctgactcccagcctacagagagattccttaagaagtggttcgactgataaacgcattgccaaaagtgaactgggatgaggtccaagacatctgcggtgggggttctccagaccttagtgttcttccactacaaagtgggtccaacagagaaaggtctgtgttcaccaggtggccctgaccctggagagtccagggcagggtgcagctgcattcatgctgctggggaacatgccctcaggttactcaccccatgacatgttggccccagggactgaaaagcttaggaaatggtattgagaaatctggggcagccaaaaggggagaggccatggggagaagggggggctgagtgggggaaagcaggagcgagataaaaagccagctccagcaggcgctgctcactcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacctccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtcagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgccgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattccatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagctcctccccatcctctccctctgtccctctgtccctctgaccctgcactgtcccagcaccatgggacccacctcaggtcccagcctgctgctcctgctactaacccacctccccctggctctggggagtcccatgtactctatcatcacccccaacatcttgcggctggagagcgaggagaccatggtgctggaggcccacgacgcgcaaggggatgttccagtcactgttactgtccacgacttcccaggcaaaaaactagtgctgtccagtgagaagactgtgctgacccctgccaccaaccacatgggcaacgtcaccttcacgatcccagccaacagggagttcaagtcagaaaaggggcgcaacaagttcgtgaccgtgcaggccaccttcgggacccaagtggtggagaaggtggtgctggtcagcctgcagagcgggtacctcttcatccagacagacaagaccatctacacccctggctccacagttctctatcggatcttcaccgtcaaccacaagctgctacccgtgggccggacggtcatggtcaacattgagaacccggaaggcatcccggtcaagcaggactccttgtcttctcagaaccagcttggcgtcttgcccttgtcttgggacattccggaactcgtcaacatgggccagtggaagatccgagcctactatgaaaactcaccacagcaggtcttctccactgagtttgaggtgaaggagtacgtgctgcccagtttcgaggtcatagtggagcctacagagaaattctactacatctataacgagaagggcctggaggtcaccatcaccgccaggttcctctacgggaagaaagtggagggaactgcctttgtcatcttcgggatccaggatggcgaacagaggatttccctgcctgaatccctcaagcgcattccgattgaggatggctcgggggaggttgtgctgagccggaaggtactgctggacggggtgcagaacctccgagcagaagacctggtggggaagtctttgtacgtgtctgccaccgtcatcttgcactcaggcagtgacatggtgcaggcagagcgcagcgggatccccatcgtgacctctccctaccagatccacttcaccaagacacccaagtacttcaaaccaggaatgccctttgacctcatggtgttcgtgacgaaccctgatggctctccagcctaccgagtccccgtggcagtccagggcgaggacactgtgcagtctctaacccagggagatggcgtggccaaactcagcatcaacacacaccccagccagaagcccttgagcatcacggtgcgcacgaagaagcaggagctctcggaggcagagcaggctaccaggaccatgcaggctctgccctacagcaccgtgggcaactccaacaattacctgcatctctcagtgctacgtacagagctcagacccggggagaccctcaacgtcaacttcctcctgcgaatggaccgcgcccacgaggccaagatccgctactacacctacctgatcatgaacaagggcaggctgttgaaggcgggacgccaggtgcgagagcccggccaggacctggtggtgctgcccctgtccatcaccaccgacttcatcccttccttccgcctggtggcgtactacacgctgatcggtgccagcggccagagggaggtggtggccgactccgtgtgggtggacgtcaaggactcctgcgtgggctcgctggtggtaaaaagcggccagtcagaagaccggcagcctgtacctgggcagcagatgaccctgaagatagagggtgaccacggggcccgggtggtactggtggccgtggacaagggcgtgttcgtgctgaataagaagaacaaactgacgcagagtaagatctgggacgtggtggagaaggcagacatcggctgcaccccgggcagtgggaaggattacgccggtgtcttctccgacgcagggctgaccttcacgagcagcagtggccagcagaccgcccagagggcagaacttcagtgcccgcagccagccgcccgccgacgccgttccgtgcagctcacggagaagcgaatggacaaagtcggcaagtaccccaaggagctgcgcaagtgctgcgaggacggcatgcgggagaaccccatgaggttctcgtgccagcgccggacccgtttcatctccctgggcgaggcgtgcaagaaggtcttcctggactgctgcaactacatcacagagctgcggcggcagcacgcgcgggccagccacctgggcctggccaggagtaacctggatgaggacatcattgcagaagagaacatcgtttcccgaagtgagttcccagagagctggctgtggaacgttgaggacttgaaagagccaccgaaaaatggaatctctacgaagctcatgaatatatttttgaaagactccatcaccacgtgggagattctggctgtcagcatgtcggacaagaaagggatctgtgtggcagaccccttcgaggtcacagtaatgcaggacttcttcatcgacctgcggctaccctactctgttgttcgaaacgagcaggtggaaatccgagccgttctctacaattaccggcagaaccaagagctcaaggtgagggtggaactactccacaatccagccttctgcagcctggccaccaccaagaggcgtcaccagcagaccgtaaccatcccccccaagtcctcgttgtccgttccatatgtcatcgtgccgctaaagaccggcctgcaggaagtggaagtcaaggctgccgtctaccatcatttcatcagtgacggtgtcaggaagtccctgaaggtcgtgccggaaggaatcagaatgaacaaaactgtggctgttcgcaccctggatccagaacgcctgggccgtgaaggagtgcagaaagaggacatcccacctgcagacctcagtgaccaagtcccggacaccgagtctgagaccagaattctcctgcaagggaccccagtggcccagatgacagaggatgccgtcgacgcggaacggctgaagcacctcattgtgaccccctcgggctgcggggaacagaacatgatcggcatgacgcccacggtcatcgctgtgcattacctggatgaaacggagcagtgggagaagttcggcctagagaagcggcagggggccttggagctcatcaagaaggggtacacccagcagctggccttcagacaacccagctctgcctttgcggccttcgtgaaacgggcacccagcacctggctgaccgcctacgtggtcaaggtcttctctctggctgtcaacctcatcgccatcgactcccaagtcctctgcggggctgttaaatggctgatcctggagaagcagaagcccgacggggtcttccaggaggatgcgcccgtgatacaccaagaaatgattggtggattacggaacaacaacgagaaagacatggccctcacggcctttgttctcatctcgctgcaggaggctaaagatatttgcgaggagcaggtcaacagcctgccaggcagcatcactaaagcaggagacttccttgaagccaactacatgaacctacagagatcctacactgtggccattgctggctatgctctggcccagatgggcaggctgaaggggcctcttcttaacaaatttctgaccacagccaaagataagaaccgctgggaggaccctggtaagcagctctacaacgtggaggccacatcctatgccctcttggccctactgcagctaaaagactttgactttgtgcctcccgtcgtgcgttggctcaatgaacagagatactacggtggtggctatggctctacccaggccaccttcatggtgttccaagccttggctcaataccaaaaggacgcccctgaccaccaggaactgaaccttgatgtgtccctccaactgcccagccgcagctccaagatcacccaccgtatccactgggaatctgccagcctcctgcgatcagaagagaccaaggaaaatgagggtttcacagtcacagctgaaggaaaaggccaaggcaccttgtcggtggtgacaatgtaccatgctaaggccaaagatcaactcacctgtaataaattcgacctcaaggtcaccataaaaccagcaccggaaacagaaaagaggcctcaggatgccaagaacactatgatccttgagatctgtaccaggtaccggggagaccaggatgccactatgtctatattggacatatccatgatgactggctttgctccagacacagatgacctgaagcagctggccaatggtgttgacagatacatctccaagtatgagctggacaaagccttctccgataggaacaccctcatcatctacctggacaaggtctcacactctgaggatgactgtctagctttcaaagttcaccaatactttaatgtagagcttatccagcctggagcagtcaaggtctacgcctattacaacctggaggaaagctgtacccggttctaccatccggaaaaggaggatggaaagctgaacaagctctgccgtgatgaactgtgccgctgtgctgaggagaattgcttcatacaaaagtcggatgacaaggtcaccctggaagaacggctggacaaggcctgtgagccaggagtggactatgtgtacaagacccgactggtcaaggttcagctgtccaatgactttgacgagtacatcatggccattgagcagaccatcaagtcaggctcggatgaggtgcaggttggacagcagcgcacgttcatcagccccatcaagtgcagagaagccctgaagctggaggagaagaaacactacctcatgtggggtctctcctccgatttctggggagagaagcccaacctcagctacatcatcgggaaggacacttgggtggagcactggcctgaggaggacgaatgccaagacgaagagaaccagaaacaatgccaggacctcggcgccttcaccgagagcatggttgtctttgggtgccccaactgaccacacccccattcc

SEQ ID NO: 2668 - DNA, 4199 bp; single-stranded, linear
cgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcattggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttc

SEQ ID NO: 2669 - DNA, 5444 bp; single-stranded, linear
ctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccattttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcattggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacaccatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtttacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttc

SEQ ID NO: 2670 - DNA, 5444 bp; single-stranded, linear; identical to SEQ ID NO: 2669

SEQ ID NO: 2671 - DNA, 15087 bp; single-stranded, linear
cgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccactttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcattggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacacaatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtgtacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttcctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccattttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcattggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacaccatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtttacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttcctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctcagagaataaattccaaaactctgcaatcttaacaatacaaccaaaacaattgcctggaggacaaaacccagtttcttatgtgtatttggaagttgtatcaaagcatttttcaaaatcaaaaagaatgccaataacctatgacaatggatttctcttcattcatacagacaaacctgtttatactccagaccagtcagtaaaagttagagtttattcgttgaatgacgacttgaagccagccaaaagagaaactgtcttaaccttcatagatcctgaaggatcagaagttgacatggtagaagaaattgatcatattggaattatctcttttcctgacttcaagattccgtctaatcctagatatggtatgtggacgatcaaggctaaatataaagaggacttttcaacaactggaaccgcatattttgaagttaaagaatatgtcttgccacatttttctgtctcaatcgagccagaatataatttcattggttacaagaactttaagaattttgaaattactataaaagcaagatatttttataataaagtagtcactgaggctgacgtttatatcacatttggaataagagaagacttaaaagatgatcaaaaagaaatgatgcaaacagcaatgcaaaacacaatgttgataaatggaattgctcaagtcacatttgattctgaaacagcagtcaaagaactgtcatactacagtttagaagatttaaacaacaagtacctttatattgctgtaacagtcatagagtctacaggtggattttctgaagaggcagaaatacctggcatcaaatatgtcctctctccctacaaactgaatttggttgctactcctcttttcctgaagcctgggattccatatcccatcaaggtgcaggttaaagattcgcttgaccagttggtaggaggagtcccagtaatactgaatgcacaaacaattgatgtaaaccaagagacatctgacttggatccaagcaaaagtgtaacacgtgttgatgatggagtagcttcctttgtgcttaatctcccatctggagtgacggtgctggagtttaatgtcaaaactgatgctccagatcttccagaagaaaatcaggccagggaaggttaccgagcaatagcatactcatctctcagccaaagttacctttatattgattggactgataaccataaggctttgctagtgggagaacatctgaatattattgttacccccaaaagcccatatattgacaaaataactcactataattacttgattttatccaagggcaaaattatccattttggcacgagggagaaattttcagatgcatcttatcaaagtataaacattccagtaacacagaacatggttccttcatcccgacttctggtctattatatcgtcacaggagaacagacagcagaattagtgtctgattcagtctggttaaatattgaagaaaaatgtggcaaccagctccaggttcatctgtctcctgatgcagatgcatattctccaggccaaactgtgtctcttaatatggcaactggaatggattcctgggtggcattagcagcagtggacagtgctgtgtatggagtccaaagaggagccaaaaagcccttggaaagagtatttcaattcttagagaagagtgatctgggctgtggggcaggtggtggcctcaacaatgccaatgtgttccacctagctggacttaccttcctcactaatgcaaatgcagatgactcccaagaaaatgatgaaccttgtaaagaaattctcaggccaagaagaacgctgcaaaagaagatagaagaaatagctgctaaatataaacattcagtagtgaagaaatgttgttacgatggagcctgcgttaataatgatgaaacctgtgagcagcgagctgcacggattagtttagggccaagatgcatcaaagctttcactgaatgttgtgtcgtcgcaagccagctccgtgctaatatctctcataaagacatgcaattgggaaggctacacatgaagaccctgttaccagtaagcaagccagaaattcggagttattttccagaaagctggttgtgggaagttcatcttgttcccagaagaaaacagttgcagtttgccctacctgattctctaaccacctgggaaattcaaggcattggcatttcaaacactggtatatgtgttgctgatactgtcaaggcaaaggtgttcaaagatgtcttcctggaaatgaatataccatattctgttgtacgaggagaacagatccaattgaaaggaactgtttacaactataggacttctgggatgcagttctgtgttaaaatgtctgctgtggagggaatctgcacttcggaaagcccagtcattgatcatcagggcacaaagtcctccaaatgtgtgcgccagaaagtagagggctcctccagtcacttggtgacattcactgtgcttcctctggaaattggccttcacaacatcaatttttcactggagacttggtttggaaaagaaatcttagtaaaaacattacgagtggtgccagaaggtgtcaaaagggaaagctattctggtgttactttggatcctaggggtatttatggtaccattagcagacgaaaggagttcccatacaggatacccttagatttggtccccaaaacagaaatcaaaaggattttgagtgtaaaaggactgcttgtaggtgagatcttgtctgcagttctaagtcaggaaggcatcaatatcctaacccacctccccaaagggagtgcagaggcggagctgatgagcgttgtcccagtattctatgtttttcactacctggaaacaggaaatcattggaacatttttcattctgacccattaattgaaaagcagaaactgaagaaaaaattaaaagaagggatgttgagcattatgtcctacagaaatgctgactactcttacagtgtgtggaagggtggaagtgctagcacttggttaacagcttttgctttaagagtacttggacaagtaaataaatacgtagagcagaaccaaaattcaatttgtaattctttattgtggctagttgagaattatcaattagataatggatctttcaaggaaaattcacagtatcaaccaataaaattacagggtaccttgcctgttgaagcccgagagaacagcttatatcttacagcctttactgtgattggaattagaaaggctttcgatatatgccccctggtgaaaatcgacacagctctaattaaagctgacaactttctgcttgaaaatacactgccagcccagagcacctttacattggccatttctgcgtatgctctttccctgggagataaaactcacccacagtttcgttcaattgtttcagctttgaagagagaagctttggttaaaggtaatccacccatttatcgtttttggaaagacaatcttcagcataaagacagctctgtacctaacactggtacggcacgtatggtagaaacaactgcctatgctttactcaccagtctgaacttgaaagatataaattatgttaacccagtcatcaaatggctatcagaagagcagaggtatggaggtggcttttattcaacccaggacaccatcaatgccattgagggcctgacggaatattcactcctggttaaacaactccgcttgagtatggacatcgatgtttcttacaagcataaaggtgccttacataattataaaatgacagacaagaatttccttgggaggccagtagaggtgcttctcaatgatgacctcattgtcagtacaggatttggcagtggcttggctacagtacatgtaacaactgtagttcacaaaaccagtacctctgaggaagtttgcagcttttatttgaaaatcgatactcaggatattgaagcatcccactacagaggctacggaaactctgattacaaacgcatagtagcatgtgccagctacaagcccagcagggaagaatcatcatctggatcctctcatgcggtgatggacatctccttgcctactggaatcagtgcaaatgaagaagacttaaaagcccttgtggaaggggtggatcaactattcactgattaccaaatcaaagatggacatgttattctgcaactgaattcgattccctccagtgatttcctttgtgtacgattccggatatttgaactctttgaagttgggtttctcagtcctgccactttcacagtttacgaataccacagaccagataaacagtgtaccatgttttatagcacttccaatatcaaaattcagaaagtctgtgaaggagccgcgtgcaagtgtgtagaagctgattgtgggcaaatgcaggaagaattggatctgacaatctctgcagagacaagaaaacaaacagcatgtaaaccagagattgcatatgcttataaagttagcatcacatccatcactgtagaaaatgtttttgtcaagtacaaggcaacccttctggatatctacaaaactggggaagctgttgctgagaaagactctgagattaccttcattaaaaaggtaacctgtactaacgctgagctggtaaaaggaagacagtacttaattatgggtaaagaagccctccagataaaatacaatttcagtttcaggtacatctaccctttagattccttgacctggattgaatactggcctagagacacaacatgttcatcgtgtcaagcatttttagctaatttagatgaatttgccgaagatatctttttaaatggatgctaaaattcctgaagttcagctgcatacagtttgcacttatggactcctgttgttgaagttcgtttttttgttttcttctttttttaaacattcatagctggtcttatttgtaaagctcactttacttagaattagtggcacttgcttttattagagaatgatttcaaatgctgtaactttctgaaataacatggccttggagggcatgaagacagatactcctccaaggttattggacaccggaaacaataaattggaacacctcctcaaacctaccactcaggaatgtttgctggggccgaaagaacagtccattgaaagggagtattacaaaaacatggcctttgcttgaaagaaaataccaaggaacaggaaactgatcattaaagcctgagtttgctttc

SEQ ID NO: 2672 - DNA, 143068 bp; single-stranded, linear
aagcttcagtatgcaaattttcaatgacatgtgcctgtggattctgaaaattcacagatctgtctatccttagctgagactgaaggcatctacttcccaatgaccaaatcctggtgctgtggcgacactgagcaggaactccattagaatatcaatatcactctgcagacattccatgatgtaagctatgttttctcttgttgcaattacacttaatttaccaccagctgcttcaatgtcatgggctatcttgaaaaatgaagctcctttcgtagtcaaactggatgcaagacacagcaaatgagaagttactaaattgttggagtcctcatagctactgcctgctttaatgaacaaaccaattcttgatgcagggcatagttttccaaaggagaaatcataaaaccatttggaaatttgatgatctcaaggtcctgatgatgtggagccactcctatgggggtagctgtggctttaactttgggggcaactttgagggaataaagtctcaaaaagagggaataaagtctcaagattgttcgtgacccatagtaacttctggcttaaaggaccattcggcaagtttttaaatgtattttctataatttccatgtagttctttatattttctatttcttatttaaaacctctattttagctcgtttcctttgacactgctctggcagggaaaggggtggcactgcctcattactgccaggtaggggtagaagtccattatccacttggtctccattgatacccaaagtggggagaggctcctgttactgctggtgagggtgggagtccccccactaagtttctgctaatactgtcctggtggcttgctactattcccatgaagcctccactgatactacattacttttgggtggtggcaaatgtcctgcctctccactagccctcctgctctaaaacaacccgagtagggagtgggaaggaagctttgttactggtaggtgggagctgaagtccagacttgccacattgtcccactgatgctacagggaggaggaagcgggccacattactgcctgatagggatgaaagccccagctccctacctggccttcgctgataccagcctgctacaggagtgaagagagatttgaaggcctcaatatagcctgtcgagggtggaagtcttgctcccaatgggcctttagcagcatgggtgggtgtggggccatagctgtctctgtactgcttggctagagtggagtatttgaggtccaaaagttttctgtctttctagccctttggttagaaagagcagacttttgttggaagtatttttttgtgtttacctgttgtatttccaggttcctagcttctccagcacagtctgggatgtgtgagacacagagaaaatccagtgatgttactaccgtatggtttcttgggtcccaacgtctctagctaatctgctccaccttttggagttttcttatttgttttagatcagggatttagtcatatttaataggagaaatatggaaaaatacttctactctatcttcctggaagttcctgtttattttttatgtccttttcctctggctagaccgtaagagacttacgaaacaaacacttacacattctactaaactcaatgtccaaagtttgtgaacttcttgaatattgcttgttcatttccacccccagtcactgactgaatctccctgctgtctgtctacaatgccaatgagcttctggttaacttcttctcatgcatgcttaggcaacaacttcccagttttactacacttgcccatccctagttttgttgttgcttaatcccttggcctagtgccaccatactcctccagcagagcaaccaattcttacattataggacagcacatatccactaaaaacagttcatgccacaccaaccacatttccctttgtcaacaaaattacttgatagataattccaggaatgcctgatgaagctgattgacaacaagatatttggcagactctctgctgcctatacataccttagcatgtggaactcaagtaatgagaggtccatttaattggattgaattgggctggataggattggattgaatcctgtgggatggctaggctaaattagaaatgaagactagtttaacagcagtatccaaggatagttgactaatgagttaattttactctcaaagacagtctttagtagtaagctgtaatgcattatatcaaactattttccagtcaatgatttataagttacttgaataaggatgctaaagatgtgccttattgaaatggcaattagcacaaagttgggaatgaaatctaattagttaaataacagaatcacataaaaaaggacttgaataaatgtagcatcctaccatgttcctggatagaaagactgctatcgtaaagatattcattctcctcaggttaaattataaactcaatgcaattcaacaggattttaaaaaactagacaaagtgattccaagtttacgtggaaaataaaatgtgagggaccaaacaatatttgaaaaagaaagagaataaaatctcatccttccagataccacaatgtattataaagcaatagtaattaacatgagggcagaaatgagcaagcaagtgaacaaaataagacagatagtcacaggaaactcatatatttataggtgctttgcgtataatgaagatggtccttcaaatcagttgggaaaagatgggttattcaataaatggtgttgggtaaaattggttatacattggtgagaaataaagtgaaactcctactttgtatcatatgcaaaaaatagattccagacagatgaaatatttaaatgtaaaaaataaaattctaaaactactagaaaaaaaagaagaatatttttattcctttgaaatagaaaaggtcttactaagcaaaacacagaagtaataaatgaataaatgaagacaaatatgataaaaataagttaaaaatataagcaatctttctttgtttttttttcacctttcctagaaaaaaatatataggcaacttgttaagcaaggtagattacaagaaaatatttacaacatttgacaggccacagattattatccagcctcatctgataagaaaacttcaacataaagatatctgttttttttcttataaggttcctcaaagtgagccaatcacttcttaagctgaacaaaaaacaaaacagaagtgatcttttccaataatgaaaacaaacattgacagagcagctgtaggatcctttcaggcaaattatgaaaaggtgccctttctcagaaaccacagttaccattcagctttgtgaccagaggtttgactgtaccctagtccctactagcaacccaaccacataaccaacttcaaaggtcctgaatgactgtgttgtacttaatggcagatgatctatctcccatttttgtcctaaggattttccaagataatatatttctgcatttgttttgcttttacttcactccaaattgaaatctatttgtgggataagactaaagaaatgcttataggaaaattgatagcaccaaattcctatcttaaaaaatgaaaaaggtttcaaatcaatgacctcagcttttactttaagaaaatagaaaaagcaggataagctaaagccaaagtaaacagaagaaaggaaattataaagataagagcagaaatcaatgaatagaaaacaaaagaaaaaaatcaaaccaaacagctgattctttaagcagatctataaaattgataaaactctagccagattgatcaagtaaaaaagagagaagacacaaattaccagtattaagaatgagagaggcaatatcactacagatcctacagatataaaaagtataagggcatactttgaataattttatgactataaattaggcaacttagataaaacaaatttcttgaaagacacaaacaaccaaagctcacctaaaatactcacaaattgaatagtcttatagctattacaaaattgaggccaggcgcagtggctcaagcctttaatcccagcactttgggagggctaggaaggcggatcacgaggtcaggagtttgagaccagcctgactaacatggtgaaaccctgtctctactaaaagtacaaaaattagccaggcttggtggtgcgtgcctgtaatcccatctactcaggagactgaggcaggagaattgcttgaacctgggaggcaaagttgtggtgagccgagatcgcgccactgcacttcagcctgggcaacagaacaagactccgtctcaaaaaaaaaaaaaaaaaaaaaaattgaaattatagttaaaagtcttcccacaaagcaaactctagacccagatggcttcaatggtaaattctactggacaatcaaacaggaaacagtaataattctccacaatgtctttcataaaattgatgcggaggagatactctccaactcattctatgaaactagcattaccctgataccaaaatcatacagagacagtgtaggaaaacaacagatcagtatccttcatgaacataaatgaagtacaatgcagtcttatgcataaatcagagcttcattgttctacagataaggtaatgtaggattgttggttgcccctccaggtctgttaaattcacctccttccccagagagcatccttcttaaggacagggagcctcaatatgtcagtcctcacagcacctccctcagtcttcagcacttaccagctcatcaccacaaccgataccacattggataatttcatgaattactttagagcaaatgcaagagaaaaaatggatttttatataggagaagaaggaggaaattcttgtggatttggtacagaatagggccaagggaaaattacagatgtaaaaagaaaagtgtgtgaaatagtatccttagtgctcacaaatacaatgatttcattgtttttaaaaataaaaaatgacaaatgtctaatgcttggtggtaatgctttattgaatgtgtgttatacactggttcctcattcctgaagttagaaataataccttcctcttttcatttggttatgtttgctgaaacaaatcaaaggctgagattgaaacacatgctacttcaggtggatgaccttactactaagctcatcacaacagcacttacagctgaagaccccagagtcctacctaacttttgtcacaacccagattttggccatgtagttctgggccttaccattaaagcagacagaagtcagaggaatgactcctttccacttgaagtgagctgcaggcttctaggaaaggcaagatgcacatttccctcctgtggagcataaagcctttgtaattcaggacttaggacccatatggatttgaaatattatgacattggagctggagtggttggggacaacaccagtagtgttataggccatggaatgtcaaaagaacatggaaccctgttaaaatcattaaacatcaaaactctcccctcctctggtgatatggtttggctgtgtccccatccaaatctcatcttgaactcccatgtgttgtgggaggcacccagtgggaggtaattgaatcatgggggcaggtctttcccatgctgttttcacgatactgaataagtctcacaagatctgatggttttataaaggggagcttccctgcacaagctctcttctcttgtctgccaccatgtgagacatgcctttcaccttccgccatgattgtgaggcctccccaaccatgtggaacttttaagttcattaaacctcttccttttgtaaattgctcagtctcaaatatgtctttatcagcaacgtgaaaacagactatctgattttctgtgggatgtggattatgaccatggacagagcataactgggacagagctggaaaaaatattaattaggtgcttaaaaatatttgttagaactatcttcatgaatgagaatcaatcctgtttccatggtgattcaccaggcatcaattccaagcatccatgaatcagaaaagtcctatcttctcttagttatcatccaggactccaaggaaccataattagccaacctgttcacatttccttttcattcactagcctcgaagtttccaggggacagggactctgtcctattcatttctgtaaccttaccacctgacccagaatagctgttccctgaagatttggtggattataaatgtggatgtcttatttctttgaaagtgtgagcttcaggtactgatcacgttattccaattatcaatttagtatctttcttcaccattaaactgtgaaattcttgagggaagaacctatgactgatttatctctgtaaactcatgccaccagtattcaaaatcacacctagcacatagtaaacactcaatgtttgttgaatgactgaaggaatggatgaaaatgaacctccttgcttctgaccagtggatgagttgcttggccgtgttcctacagcctagagctcatcccctaaagcatctgaagttacccattagtgcaatggttcttgaacgctggtgttgatcagaatcatctggatgcccaggttctctgaaataagatagggtctaggcatttgtatttttaccaaggaggtgtgatggagtcagatgcaagaaggctagttgaagaaaccacatgagagtttagtgtagtgtattagaagactggtttggctctgtcgctagtggctacatcatcttgctcaagtcatgccagtctcaggacctcattcagtctcttcagctgtaatatgggtgggttgcaccacataaccagaaagatcccttccagctctacccacttacaacatggtcaaatttggtctgattttttaaatcgtagtacaatatatatgacataaaattcaccattttagccactttaaatgtacaattctgtagcattaactacattcacattgttgtgcaaccatcactaccgtctacttccagaactcttcatcttgcaaaactgaacctctgttgtcattagtcactaactattcctctccccccctccttctaggccctggcaatcaccattctactttctgtcgctatgaatttgactactctaggtaacttatataagtggaatcacagcatttgccctattatgactggtttagttgacttagcacaacctcctaaggctcaaccacattttagcatgtgtcagaattttctttgtttttaaggctgaataatattctgttgtatctgtaaataacatctttattcatttgtccatcaacagactgttgagttcctcccatcttttgactattgtgaaaaatgctgctatgaacctgagtgtacagacatctggttgagtactgctttcaattcattgtttatatggatcatatggtaattttatgtttaatttttttggaactgctacattgttttccacagtgtacatcattttacatttccatcagcaatgcacaaaggttccaatttctccacattcttaccaacattttttattttctgtttcttatttatttgtttatttattctgagacagagtctcactctgtcacctaggctggagtgcagcagggtgatctcagctcactgcaacctctgcctcccatgttcaagtgattctcctccctcagcctcccaagtaaatggaattacaggtgcccaccaccacgcccaggtaatttttgcattttttttagtagtgatgaggtttcaccatgttggtcaggctggtcttgaactcctgacctcaagtgatccacccgcctcagcctcccaaagtgctgggattacaggtatgaaccactgcacccaggccattttttgctttttagataatagtcatcctagtgggtatgaagtggtatttcattgtggttttgatttatatttccctaatgatcagtgatattgagcatctttcaagtgcttattggccattttcttctttggagaaatgtctatgcaagtcctttgctcattttttaatccagttgctttttgttattctttttgatttgaaagtgttctttatacctcttgtatactaatcccttatcagatatgatttataaatattttcttcttttccatggattgccctttttactctgttgatagtgttctttgatacaaaataatttttaatttgaatgaagcccaattaatctatttttgtttcttttgttgcctgtgcttttggtgtcctatccaagaaactgttgccaaatccaatgtcataaagctttttcccatgcttccttctaagagttttgtagttacagctcttgtatttaggtatttgactattttgagttaatttttgtacatcgtataaaataagaatccaatttttattttattttactttttgtatgtggatatccaatttccccaccaccattcattgaaaagactgtccttttcctatcgaatggtcttggcacccttgtaaaacataatttgaccatatatgtgagggtttatttctgggctctctattctattctattctattctattctattctattctattctattctattctattctattctattggtccctatgtctttctttattctagtaccaccattttgctcatcataactttgtagtaagttttgaagtcaggaatcgtaagacctccagctttgttcattttcaaggttgttttgattattcaaggtcccttgatagtccatatgaatttcaggatggatttttctatttctgcaaaaaaaaaaaaaaaaaaaaaaaaaatcattgaaatttttaaacagattgcattaaatctgtagattgttttgggtagtattgacatttaacaacattaaatcttccaatcaatgaactaggctatttttatttattttttctgtttctttgagctacttttgtagttttcagtgtataagtttttgctacctggttaggtatacttctaagtattttctactttttgatgctattgcacattgaatcgttttcttaatttggtggtagcggggattgtgcattgttagtacataaaaatgcaactcattttttgtgtgttgattttgtatcctgcagctttaacaaattcatgttagttctaacagacttattctatgaatcattagggttttctacataaaagatcatgtcacctacaaacagagataattttactccaccccttcccgttgcaatgccttttatgtctttttcttgcctaattgttctggctaagacttccactaccatgttgaatagaagtggtgaaagtagacatccttgtcttgttccaatcttagagccaaagctttcagtctttcacggcctgaaagactttgtaatatgttctcaaggttaaagaacttcagaagttttctaagcaagagaccattttattaacttagttggcagcaattctgagagattagaatgaaaagatagaggataagaagtatctggcaggtataatatattgagtgtgctgaatatacttttagttttgtataggtgttaaaaaatggcaaaggaggccgggcgtggtggctcacgcctgtaatcccagcactttgggaggccgaggcgggcagatcatgaggtcaggagatcgagaccatcctggctaaaacagtgaaaccctatctctactaaaaatacaaaaaactcgctgggcatggtggtggacacctgtagtcccagctactcgggaggctgaggcaggagaatggtgtgaacctggaaggtggagcttgcagtgagccgagatcacgccactgcactccagcctgggcgacagagagagactccgtctcaaaagaaaaaaaaaatggcaaaggaaagaatgaaaaataaagcaaggtcccagaagaggccaaaaatcttaatcaaaattgactgaacattacggaatgaaatggtttttcctttactccaattaacgacttcacaagaagattccatcctcgtttataagattaacccaaaaccagcacttaaaaccagaagccttgaaaggatggagtttggggacccttctcatgtctattcccagaagggggtcttcttctggggtcctgtcccctaaagagctaggcaaaaagtatgcttgccacatctgttgaaagatagaaagttggtctaaaaatacatgagagggaactgaaacatttcagagaaggcaagactcagaagtaagaaaccaaaagaggaaggtaaaattctagttacaaagaaaagaggaatggaaattaaattgtcttacagagaaaatccagaactgccccctcttcccttactactccatcaaaaaaggggaaaaatagtcaatgggaaagttttgagaaaaatagatctctgcattcttctggttgagaattcagacaacttgaactagagagctgggtaatttcttgactaaaggtgtgttagatctgaaagggtttttcttaaaattgtctgtgttcatccctcccatcttagagaggaacacaggataagagacctctggagctcccccagggtcaccgagctaataggatcagagacaaagctacaaagtcattttctgacatctctccagggctctttttttctggaccccccatatcaacatgatgtatttattacattggattagcaactctccttgagctttcctcagtaccaggtttacatctcagtctgtgggtctcagagaaagtacccaatcagcagcaacattacctggaaactcatcagaagtgcccctcctcagccccaccccagatctatgcaatcagaaactctggaaatgcaggccagtcctaacaagcccaccagggaattctggtgcactaaggtttgagatccactgatcaaagaaataatattccttttcttcattataatagcatgaataataactaacatgtatttcacaatttacaaaagagctttatgctcttgttaaatttgagggtagtcttctcaaaatctctgtgaggctagaaagtcagatattgaaacacctgttttatgggttcaaagataggttcaaaagagagtaaatgattgttggggtggcaggtccagagagggcaggatcaaaactgcaattgagtcttctgccttataaaccagcatagcttccccaaggcacgtcacttctcgataaaatggtgacaactagagtgtcctttcagatcattcttagaagcatggagtgctaggtcaattgtgtaattgatgaggaaataataatactaagaactcccatcttctacgtccttatatacaatcctgtcaggtagaagctgagtctcagagagaacaagttgccctcccaggaccaccaggtaagctcggcatagctgtgcttagaatgtaggctgtctggcttctgggcttgcctgcccagggaggctttgtgggttctacttggtcatccagatcacagaggggcagcactgactcctacccagtgctcttgactgtacatctaatactttctactaagaaaaccccttctctttagaccaatggttttcaaatcttggtgtgcattggaatcacctggaaagcttgttaaaacacagattgtcccaccccaagagtttctgattctgtaggctggggtggggacccatgaaagtgcatttctaataaggtcccaagtgatgctgatgccaccagtgtgtggacaaccctttgagtggtgaagctctggacaccctaatttgcaaggctaatcaggcatatgtggcaaatgaatacgaactgaaattctgactccaatatcttcactgatattcctaatccatagcatacacacagtcccattcgtttcccttttagcttttaatctacatttatcctttcttcctctgccactgccttctctccagttagctcaaaccaggtaacacataaccgcctcctaactcatccgcccagttggtttctttggctttaatctagacttcttatctccaccagatttgccttaccaaagcaccaatttcttaaggcagggttagaattaaaaatcttctgttcctcctcattgcctaaaactcctaaacttatgattcaaggtcttccatgaccttcatggaccagtctaacgttttagcctgtcctaagtgacatgcctccaccacatacttcatgctttccactttctttctccatgtctttgttcatgcatttccatttcttctacctgcgatgtcctccttcgccatctctgtagatttaaaaatcctacagggctcatctcaaatgccctttccttcatgaagcctttcatgaaatccccatcgagaggttttccctcctctcagctctccaaagcacagatgtctgcgtttgtggctattatcttacgttgttttgtattaaaatttctccagctttacacatttgtcatcctcttaaggacaaacatcttattatggtcaatgtgaagctatagaggataatttaatgaaatattccaagggctagtcattacacatgactgatttatctctgtaaactcatccacactcatccacctgattttgattggccaagttaatgaatcagagaggaaaagatggtaaaaatataataaaaatctcctaggtagtctcacatcccacagagccccaggtaatgaaatgaggccctgagataatactttatgaacaataaaactccgggttctattgacagtgaagcaagacctgagagagaaggctaaattcccttgtgtctagctgccacaatcttctgagaataatggcctttcttcccgtctgccttctgaatcataggcaaatttttctctttggtgatccctaatacagaaaggggaagtcaaataaaatatatacaaggagaaggattctgggagacagagtttcttgattcccttctgcatgctcctcctcaaaagcctttatgagcttaccttacatttaaattcttttaaacaaggcattatgtggtctggtcttttccagctccacacaccttcacactacattccccccagctaattctgctctgggaacactgaccttcttttagttctttgaacacattgatttctggtcaagatgactcagtaacttcaacctttgttgtgcccttggtgctgtgaagatatagatatatattaaccactgcacaccagaaatcagaaatagcacaacagagaataaagtcattgagccatcttctgagctccaaaagacaaattttctccaaaaagacaaattcaggctctaaaacaataccttaaggaaccagaagtggaatagaaaattaaggtggtaagcagggctaaaccacatgcctgttgagcccaggtttggaagaagacaatggcaggtaggaatgtggtttctgatgggtaataggtactgttttcatttactttctgttgcttataacagaatatctgaaactgggtgctttataaagaaaaggaatttatgtcttgcagttagggaaactgagaagtcaaaagttgagggctgcaattgacaagtgccttcttgctggtggggatactctgaagagtcttgaggtggtatcgggcataccactctcagtgaggggactgagcatactaggtcaggtctttcttcctccttttataaagctatcagtcccactcttatgataacccattaatccattaactgattagccaattaatccatgaatggattaattcattcatgagggcagagccttcctgacccaaacacctcttaaagactccacctctcaatactgccacatgggggattaaatttcagcatgagtttttgatgagacaaatattccaatgatagcagttattaaaagtacatgcttgagagaaggggattggagtcagcctcagtgcttaaactcaaaagctaggatgaggctctaacactcctgaaagaaggagttgctgctggctccttaccagggctatatcttttacagagcaggagacctaaagaggcaggaggacccggacatcgtttggaaaccaagcactaaaacaggccatctgttatacccccaatatcctctcaggacaagtgttttgaaccactcacacaaggactagtctgggcaagtgggctagatgaagaaaccacaaaatagctaagtggggagagaaagaccaaaaatactattttattcaaaatgaaaatacaatccaaaattccatgattcatgaagaaatcaaatggtatgtgttaggtggttcttgcattgctatagagaaatacctgagattgggtaatttataaagaaaagaagtttaattggctcataattctgcaggcttcacaggaagcatggtgctggcatctgctcagcttctggagaggccccaagaagatttgctcaaggcagaaggttaagggagagctggcacatcacatggtgagaaaggaagctagagagagagtgcagggtgaggtgccacaagttaccacagccagatctcttgagaactcacttactttcatgaggacagcaccaagccataaggtgtagggagccaaagtcccatgggacatgaccaactcagcattccactggaggctatatgatcaaacagcaaactgtttatcacgaatgcaggatgtgagcaaactcacaactggtcctgccaacagaaggtttgttggaggcaatcactccctggtgcctgaggtaatctactgcaacatctagagaatgcagtcttgcaagcctactctggacagggcagctggcaccttattccatcccccttctcactatctttttttgcctaataaatacagagggctgtgtaaagctcagggcccttgtccactagaggcaagttgccccctgaccccttcttccaaatatactcttttgtctcttgtcttttattctcacatttgccccctttgttcagttccactaggtccgtgcgggttatatactggtgccctgagcagcaacagaatcaggctctcaacaagtgtcatccgaacatgggactttgaggacatgaacgaagaaggtctgctggagcagaggaacagaaattgacaaggtgaacagggaccctgggacgagtctgccagcagcggatataaggtcagttacctaaagaggtactgatcagtgccctaaagagatactgggagcagtgctttaaagaagtactgggaatgggaaattttctgaatcagggtaacaaggggaagaatttgtctattaaagaaaaacattatgtgcagttgcttaaagttgtattggaacagtctggagcttaggttaatttgcagacactaactatcacatgcgtccgtgtgaagagagtccaccaacaggctttgtgtgggcaataaagctttttaatcaccttggtgcaggtgggctgagtccaaaaaaggagtcagcaaagggagatagaggtggggcagttttataggatttgggtaggtagtggaaagttacagttaaaagtggttatctcttgtgggcagaggcaggggtcacaaggtgctgggtggggaaatcatgagactctttttctgggacaggagtgtcacaaggtcaattgatcagttggggtggggcaggaacaaatcgcaatggtggaatgtcatcacttaaggcaggaactgactatttcacttcttttgtggttcttcagttgtttcgggccatctggatgtatagtgcagctcacaggggatatgatggcttaggttgggctcagagacctgacattcctatctttttatattaataagaaaaacaaaacaaaatagtggttaagtgttggggcagcaaaaattttttggggtggtatgtagagataaggggcaatgtttctcagggctgcttcaagcacgatcacggtggtgtgggaatctagagtgggagagattaagctgaagaaaaattttggggaaaggggtgatattctggggttgttagaaggagcatttgtcatatagaatgatgatggcctggatgtggttttgtatgaattgagaaactaaacggaagacacaaggtccaaataagagaaggagaaaaacaggcattaaaggattaagaattgggaggacacaggacatccaattagagagtgcccaagggggtccagtgtaattatttgcctggacaatgagttttggggctctattaggttgtcatataccaggccagattgatttaggtaaaaacaacactcttcatttaaaatatacagagtcctccttttttagcagtgagtaagttgagacctattcctgtcttcttatattaataagtaaaataaagcaaaatagaggtgaagtgttggtgtcatgaggggaacaggaagcagttcggtcctatttgcaaattgattttgggggggtaaagaaaactagtgtacctttgcctgtccaattaataagtagacacatgtagatggaggagccacagaggaagaagagaactttgtaaggcaaaactggaaatgtaaagggaaaagatgagagggagcaccaaaagaggtgtcttgcacccagactcagggatctagtgagagcagcagctgttagaggttgtaatggggattaatggggctactgggtagagggggaggttcaacttttatggtgtatgagaaagcgcatagtgtctacaagcaacctttcattgctattcataggattgggtataagtaaacaagaagggggggctaggaggagagtctgaagaacaaggggaaggtagccaaggatggagtgaaatgtagggcaaatgtcttaaaggaaatgagaggttctaagaggagggctagtggcttgtaacccacatggaagaggttacgaaaggatgatagaatggaatgagcctgtgaggctggaaggaggaattttccttggtccaagaaccatttgccttgtgtgggaagagtttgataggtggaagtttcagtgggagggtaggcgggagtgactgatgagaaggagaaaaactggccataagggacagaagttggaatgctagctgctcctttagctaccttatcagcataagctttgccctgagtgatgggatctgatgccttttgatggcgcttgcagtgaatgaccctagcttccttggaagtagagcagctttaagaagagtttttatgaagaaggcattaataatggaggaccctcgtatagtgaggaaacctctttcaggccatataacagaatggaggtggagaatatggaaggcatatttagagtcagtataaatactgacacacaatccttttgcaagagtgagggctcgagttaaggcaatgagttcggcttgctgagagggagtggagtggggcagagtggtagcctcaatgatagatgtgaaagatactatagcgtagcctgcctttgctggtgagtggtgattaggcctagtggaactgccatcaataaaccaagtgtgatcagagtgaggaacaggaaagaaggaaatatgggaaaatggagtgaatgctaggtggatcagagagatacagtcatggggatcaggtgtggtatcaggaataatgtgggaggccagattgaagtccaggccaggaacaatggtaattgtgggagactcaacaaagagtgagttcaactgaaggagccgggggagggggagagcggcagaaagtatatgcatcaggtgtgaggaagaaaatacattttgaaagttatgagaactgtagagagtgagttgatcatagtttgtgattttgagggcctttaaaagtattaaagcagtggcagctgccacacacagacatgagagccagcctaaaacagtaaggtcaatctgtttagacagaaaggctgcagggcactgtccaagctcttgtgtaaggattctgaccgcacagccttgtactttggctgtgtgtaatgaaaagggttgggatgagttagggagagctagtgtgggagtagcttctagggctgtttttaaggaacataaagaggagtggggaaaggatttaggatctatggggtcagctaggtttccttttgtgagtttatgtaatggtttagtcaggatggcaaaaccaggtatccaaaggtgaaagtacccaaccatgtctaggaaggaaaggatttgttgctttgtagaagggattggggtttgggagattagccggacacagatcaggagggagagcacttgtatttttatgaagaattatgccgataggtaacggatgaggaagaaatttgggctttggagggggatacacgatattcccttgagaatagatgttggaggagcaggagggtgtcctgttgggaagattcataggaggggctataaagtagaaggccatcaaaatattgaataaggtgacaagcagatggacagaaaagtaaattatgagaaagggcttgactgaagtaatggaggctgtccctgaagccttgtggcagtacagcccaggtaagttgctgagactgatgggtgtcagggtcagtccaagtgtaagtgaagagaggctggggtgaagagtgcaaaggaatagtaaagaaagcatcttcaagatccagaacagaataatgggttgtggagggaggtattgaggataggagagtatatgggtttggcaccacagagtggataggcaagacaatttggttgataagctgaagatcctggacaggctttagtcccttcaaagcctgttgtgggatgggatactggcattgagcaggataagggtaattaggttttaatgggatggtagggttgcgtgatcggtcaccaaggagggagtagaggtatcccatacttgtgggttaagatagggagtcaggaggggaggttgtgaaggaggctttgaactggggaaaagggtggcaatgaggtgtggctgtagcccaggaatagtcagggaagcagataatttagttaaaatgtctcaatttaataagggagctgggcaggtgggaataactaaaaaggagtgcataaaagaatgttgtccaagttggcaccagagttggggagttttaagaggtttagcagcctgaccatcaataaccacaacagttatggaggcaagggaaacaggcccttgaaaggaaagtaatatggagtgggtagcctccatattgattaagaaagggacagacttaccctccactgtaagagttacccaaagtgtctgtgatgatccaggaggcttctgaggtgatcaggcagtgtcagtcttcagctgctaagctgagaagatctgggaaggagtcagtcagagagccctgggccagagttccaggggctctgggagtggctgacgggcaagttggacagtccgatttccaatgcggtcccacacagatgggatacagtttaggaggaatcctgggctgtaggcattccttggcccagtggccagatttctagcacttgaagcaagatcctggaggaatgcctgaccacagtggtttaggtgttttgaagttcttgtgtgctggagatgtggctgaggtttttctcacagcagaggcaagtaattgcaactcagaaatacattgccacttggctgtctcttctctattattgtacaccttgaaggtgaggttaattaagtcctgttgtggggtttgagggccataatctaatttttgaagcttttttaatgttgggagtggattgggtaataaaatgcatattgagagtaagacagccttctggcccctctgaacctagggcagtaaaatgtctaagagttgttgccaaagggaccatggactgggctgcgttttcatatttgatgaaaaaaaaagagcctaaatgctaactaatttgggagaggtcagataaagtaaaaggaacattaatcttgactatgccttcagctcttgccacctctctaagaggaaattgttgggcaagtggaggagtgctagtcgtggaatgaaaccataagctggactgggtgtgaggaggggaggtgatagaaggattacagcgtaggggagtagaggctgaggaagaattgggacctggctcagcctggtgaggagtggcctggtgaggagcagcctggggaggaggagagaggttagatgggttcgtagaaaagaaggattcaaaggactcggagcttggtgaggagactgaaggaacagacaggagagaaagaagaaagatttgggacaagtcgcattgggagcagagactaggaagggagtgatgtgtaaagaatgcctggacatcaggcacctcagaccatttgcccattttatgacaaaaattatctaagtcttgtagggtggagaaatcaaaagtgccattttctggccatttggaacaattatcgagtttgtattggggccaaatggtgttgcagaagaaaataagatgcttaggttttaggtcaggtgagagttgaagaggttttaggttttttagaacacaggctaaggcagaagaaggaggaatggagggtggaaggctgcccataataaaaaggtaagtttagagaaaagagaggatagagacacagagagagggggtggtggtactcatcagccaggggaggtggtacttgccaccaaggtgatggatcaaggcagtcatccccacggtgatcagacacctctgaaatgtgggtgaataatcaggcaggtgtccctgcagtgattagacaccaaggggagactgtcttcccgagtccgtgaccggtgctggagttttgagttcacagataaaacacatctcctctgtctctaccagaaagggaaaggaactgaaattaaggaagggagagattgaagggtggagagatagcaagagagttggaaaagagaataaaaagaggccacttactcaatttaaaattggtgagatgttccttgggctgatctgaggacccaaggttgtaggtggatctcctcacggaatgagggtgaggacaggggactggtctccagaaggagttcccgagtcctggatcttcagcaccaaatgtcatgtgcatccatgtgaagagagtccaccaacaggctttgtgttatcaataaagctttttaatcaccttggtgcaggtgggctgagtctgaaaaaggagtcagcaaagagagataggggtgggtcagttttataagatttgggtaggtagtggaaagttacagttagaggtggttatctcttgagggcagaggtgggggtcacaaggtgctgggtggggaaatcctgagacttatcatccagggaaggagtgtcacaaggtcgattgatcagttggggtggggcaggaacaaatcgcatggtggaatgtcatcagttaaggcaggaactcactatttcacttcttttgtggttcttcagtttcttcaggccatctggatgtacacgtgaaggttacggggatatatgatggcttagcttgggctcagaggcctgacactaacctcctgcagaagccacaaaaggttattacacataaaccatggtttccacaggcaggcactcttgatgtggaaaattgggatagagcaggattaaaacaagctcatcaaaaaggtcttaaagttgattcttcagttttctccacttggagtttagttcatactgtacttctgccattatctccttattattctgcggaacagcaggctgaatctaaaaattggaaagaatttgttgtcctactcacagctccaattgaatataaaaaacaggagagggaggataaaaattggcctataccgcctcctccagatgcagaaacatctgtaccatctccttcagtggcagaaatagagatcccagtacaaagaattttatgctctgctgtcatagctggagagcccttaggaccttgtgcttttcctatttctgtaaggcctgatccaaataatccacagcagtttattcatgaacactctccactagaatttaagttgttgaaggaattaaaaactagtgtggtcaataatggagtacaaagccaatggttcctggaggaaggaatgctagacatagaactttgggagcaagtggggagaaatcttaaacaacaccaggcacaaaggcatcaggtcccagtaaaatcttttatgttaggggctttgagtagagcagccctggttgttacacacaaaagagcctaaaaagggaaaggaggaggaaatgtcacctgccttatcacctccccttccctcagtgccaatatcactgggccaaaataacaaagaggaaatggaggtcttacctaagcttcctcctccaatagataggaagaaggacagaggatacgctacagctatcagtccctgtcttaagcaggcagcattagaaggagagctcttagccgggtgcagtggctcatgcctataatcccagcactttgggaggccgaggcaggcagatcatgaggtcaggagatccagaccatcctagctaacatggtgaaaccccgtctccactaaaaatacaaaaaattagccaggcatgttggtgggcacctgtagccccagctacttgggaggctgaggcaggagaatggcatgaacccaggaggtggagcttggagctttcagtgacctgagattgcaccactgcactacagcctgggcaacagagcaagactccatctaaaaaaagaagaagaaggagagctcttaacctgctcagtaatgcaaaatcggcaaggcaatcaggtgtatgtttataaaaagataagaaaaaggcattagaagccaaaaccacgtggccaagcaggcagtgggcaggagaaaatgctcagaggcagaaaagctcacagcgacaaagccaacaaggtctgcccaggacggcagcatccctctggcaaaggagcaagggagcagcacagacacaggcaaagcctaaacaagtacaatgtggccacctcccaggacctgcaccactgccctctggctctgtgggcagcccattgcaaaatttcatgtgttacatctcaggctatgattctctgctaagatgtaagtaaaatgtaagaatttgaaaagcatcttttctaataatggccactattgtcatctctctcctatccctgatgtagctttccaaattcaatttaagtaaaacagtaacctttgaagggaaagagattacagagggcccatgaattagttgaagagtaattaaaagctaggcatgtaaaaccacacattacgctttaaagaagaaatttaaacctaattaaatgatatttgttaaattagaaggtaaaaatgttgtgccctgttgggaacaggcccccaaatctggccataaactggccccaaaacaggccataaacaaaatctctgcagcaccatgacatgtttgtgatggccatgatgcccaccttgaaggttgttggtttactggaatgagggcaaggaacacctggcccacccagggcagaaaattccttaaaggcattcccaaaccactaatgatagcatgagcaatctgtgccttaaggacatgttcctgctgcagacagctagccagagcccatccctttgttttggcccatccctttgtttcccataaggaatgctttcagttaatctatgatctatagaaacgatgcttatcactggcttgctgtcaataaatatgggagtaaaactctgttcagggctttcagctcagaaagccataagccccctgatttcccacttcccaccctttatttctgtgtgtgtgtcttgaattcctctagcgcctctgggttatggtctccacaaccacgctggtcttggcagtgcccttctcagaaagtgaaaaagagttgtatgtaagtgtagtgaaaacataagcatgaatcactgtcttaacccactgattagatagtctttgatttgtacttgctaaaagagtcctaaattgagttcctcagctagtgagtcactgttttcaagactgtttgccagattgaagtccataaacttggtcagcccgaaaactcaattacaagatctaagctattctgcctgtggctttaagcacatggttaaagtatattatttaagtctctccttctagatatgctttcagattttctttttaaacttcttgttacttatttcagctttccatattgataattaatgcagtcaattgctcagttatgactgtgatatcatcaggattcctttaagtaaaaggcaattcaaagcggtattgcactcccccatacctaatgctttaacactgtttactgatgggtctggtaaacatggaaaagctgcagtctagtagagaccacataattcaatcactcgatctgagttcactagcactcagagagctaaggttactctgtttatttattaaagaatttttacaaccttaagctcactctggactttccagccttatgtggcaaatgtagccatcaatttatggggtcaagacttacttacagcatgggatatgaggcttacaaatgagactttgataacccaggattttaaatgttgaagaacacgggatatcagagtgaaaaaggtttagggaaaattctgacaagggaaaattctaacctgatatcaataactggaaagacaggttaaaccctgcaaggggatacattgacattttttcttcctcacttgctcttttctgctgtctgaatatgggcatgagggcaagagtcattttagaccaccaagtgaccttgaggatagaagccttatactagaggtggtgggaaagaaaaaacagaaggactcataaagaaaaaaataataaacctcagtattaagatggaaaaattcccccaattggtctataggttgaacttcatctctattaaatttcagctatgtttttgcagaatttgatatgctgatcataaaatttatatgaaaatgcaagagacacagaatagtcaaaactttgaaaagaagaaagttggaggacttacacttgttgattttaaggctttttacaaagctataataatcaagacaatgtgttactgacataatgatagacatattgatcaatatagacaatggatgaatggagtagaattgacagtctagaaataaaaccttatatatatggtcaatttatttctttatgtattctgtcatccagaatacataaagaacaccttcaactcaataacaacaataccaacaagggtgccaagaccaatcaatggaggaaataatagtcttttcaagaaattttgctgagacaactaagtatttatatgcaaaataatgagtttgaatggctaccatatacaaaaattaactcaaatggactatattaggtcagtgcaacagtaattgcagtttaccaccattacttgttttttttttttggtttttttttttgagacagagtcttgctctgtcacccagaccagagtgcagtggcatgatctcagctcactgcaagctccacttcctgagttcacgccattctccttcctcagcctcctgagtagctgggactacaggcatctgggtaatttttttgtatttttagtggagatggagtttcaccatgttagccaggatggtctcaatctcttgacctcgtgatctgcccacctcagcctcccaaagtgctgggattacaggcatgagccaccacgcctggcctaccattacttttaatggcaaaaatgcagttacttttgcaccaccctaatagaactaaatgtaagagctaaaactacaaaactgttagaagaaagcataggagcaaatcttaatgacatgagagttggcaattgttttttagatatgacaccaaaagcatcaaggacaaaagaaaaaaatggataaattggacttcctccaaattaagagaacttttgtcctgcaagcaatactattaagaaagtgaaaagacaagtcacaaaatgggagaacatttttgcacataatatatttaataataggctgacatccagaatacataaatacctacaactcaataccaaaaagacagcccaatttaaaaatgggccaaggatatgaataaacatttctctaaagaagatacaaaaatggtcaatatgcacatgaaaagatgctcaatatcaatatctattaggaaaatacaaattaaaacacaaaatataaaacacaagatatcaatttacactcaccaggatggctgttatcaaaaagacagataacaagtattggcaaggatttggggaaattgtaaccttcatacattgctggtaggaatataaaatttgcagcaggtttggaaaacagtttagcagtttctcaaaaagcctgggcatggtggctcatgcctacaatcccagtgctttagggagctgaggtgagaggattgcttgagcccaggagttggagaccagcctgagtaacacagtgagacctcttttctaccaaaaagaagagagttaaacatagggtaccatataagccagcaatccatctcctagatatgtacccaagaaagttgaaaacatatactgacacaaaaacttacatatgaatcttcatattagccttataataatagccaaaaagtagaaacaacccaaatacccatcaactaattaaaatatggtgtatctatacatattatttggccataaaaggaagtactgatacatgtcataacacaaatgaaccttggaagcactatgatctctgtattagtcagctcttgtattgctataaagaactacctgagactgggtaacttataaagaaaaaggcttaattgagtcacagttccacaggctgcacagggatcatggcccaggagacctcaggaaacacagttatgatggaaggaagagagtgaaggaggaggtgctacatacttttaaaccaccagatcttgtgagaagtcactcactatcatgagaacagcaagggagaagtccacccccatgatccagtcagccccagccaggccccaactccaatattggggattacaattccacatgagatttgggtggggacactaatccaaacaatatcattctgccccagcccctcccaaatcctgtgtccttctcacattggaagatacaatcatcccttctcaacagtttcatttcagtattaactcaaaaatccaaagtctcatctgagacaagacaagtcccttccacctatgagcctataagatcaaaaagaagttagttacttccaagatacaatggaggtacaggcattgggcaaatatatccattccaaaagggaaaaattagccaaaacaaaggggccacaggccccacgcaagtccaaaatcaagcagggaaatcattaaatcttaaagcttcaaaatgatatcctttgactccatgtctcacatccaggccacaccaatgcaaggagtgtgctcccaaggccttgggcagctctaccctgttgctctacagggtatagcccccatggctgctttcacaggctggcattgagtgcctccagcttttccaggtacacagtgcaagctgttagtggatctaccattctagggtctggaagattgtggccctcttctcatagctccagtagacagtgccccagtggggaatctgtatgggggctgcaaccccacatttctcctctgcactgcccaatagaggttctccatgagggctccattcctgtagcatacttctacctggacatccaggtgttttcatacatcctctaaaatctaggtaggggctcccaagccttaactcttgccctctgcacatccgcaggcttaataccacatggaaaccaccaatgcttatggcttgcaccctatgaagcagtagtctgagacatatctgggcccttttggccatggctgggatgcagggaacagtgtcctgaagtggcacagggcagcggggccatgggcctggcccatgaaaccttctttcctcctaggcctccagacctgtgatgggagggtctgcctcgacggtctctagaatgtgtttgaggcatattcctcattgtcttggctattaatatttggctcctctttacttatgcaaatttctacagcctgattaattcctttccaaaaaaatggggttttcttttctactacatggtcaggtcacaaattttccaaacttttacgcttccctttgaaatgtaagttccagttgcaggtcatttctttgatcacaaatataagcatatatttgtagaatcagccaggccacatcttgaatgttttgctgcttagaaactgcttccaccagataccctaaatcattgctatcaggttcaaaattctacatatctctagggcaagggcacaatgcctccaagacctttgctaatgcataagaaaattgacctttgctccagttcccaataagttccccatcttcatctgaggtctccttagcctggacttcattgtccatatcagtatcagcattttcatcacaataatttaactagtctctaagaagttccaaactttcccttatcttcctatcttcttctgagccctccaaactgctccaacctctgcccattacccgggttccaaagctgcttccacattttcggtatctttatagcaatgctccattcctgataccaattttctgtattagtctcttctcgcactcctgtaaagaactacctgagactgggtaatttataaagaaaagaggtttaattgactcacagttccacaagctgtataggaagcatggttcagaaggccacaggaaacttacaatcatggaggaaggcgaagagaaagaaggcacgtcttacgtggctggagtaggaggaagagagtgaagggggaggtgttacacacttttaaacaaccagatcttgtgagaactcactcactatcatgagaacagcaagggagaggtctgcctccatgatccaatcacctcctaccaggctcctcctccaacattggggattatgatttgacatgagatttgggtagggacacaactccaaaccatatcaatcccatttatatgaaatgtccacaatagataaatctatagagacataaaatagattggtgcttgcctagtgctggacgtgacaggagggtgtgagtaaaagaggcaatggagtgataggtacagggtttctttttggggtgatgaaaatattataaaattagattgtggttatagttgtataactcttgaatatcctaaaaatatattgaattttccatttccattttaaatgggtgaatcttatggtatgtgaattatatctcaataaaactgcaaaaaatgcacaatttgcaattgcaaaaatatggaaccagtccaaatgcccatcaatgagtggataaaggaactgtggtatatatatatatatatatatatatatatatatatatatatatatatatatatatacacacacacacacaccatggaatactactcagccataaaagggaataaaacaatggcattctcagcaacctggatggaattggagaccattattctaagtgaaataactcagtaatggaaaaccgaatatcatacattctcactcataagtgggagctaagctatgaggatgcaaaggcataagaatgatataatggactttgggaactcagggaaagggtgagagaggggtgaggaataaaaggctacccattgggtacagtgtacactgttcaagtgatggctgcaccaaaatctcagaaatcaccactaaagaacttatttacataaccaaataccacctgtttctcaaaaacctattgaaattaattaatttttaaaaactgctgaaatcaatagtgaaaggatggactattcaataatgacacagttaattgaatatcatattttaaaaattagatccttacctcacactataacataacaataaattccaggtgaattatagaccaaatatgaaaagcaaaattttaatattttagaagacaatttttatgaccttaagttagaaaatgatttttaaaaacaggatgcaaaaacactaatcataaagagatattttaggccaagcatggtggctcacacctgtaatcctagtactttgggaagctgaggcaggtggatcacttgaggtcaggagttcaagacaagcctggccaatagggtgaaacatgtctctactaaaaatacaaaaattagctggaaatcgctcgaacccaggaggcagaggttgcagtgagctgagattgtgccactgcactccagcctgggtgacagagagagactccacctcaaaaaaataaataaataaaaataaagagagattttaataaggtgcattaaaataaaaaactatccatcaaagacaccatgaataaagttaaaataggccacaatgagaatatatttgccatgaattttttctttttttttgagatggagtcttgctctgtcacccaggctggagtgcagtggtgcaatctcggcttactgcaaacttcacctcccaggttcaagcaattctcctgcctcagcctcctgagtagctgggattacaggtgtgtgccaccatgcctggctaatttttgtattttttgtagacacggggtttcaccatgttggtcaggctgagctcaaacccctgacctcgtgatccaccttcctcagcctcccaaagtgctgggattacaggcatgagccaccgtgcctggcctaccatgaatatttttttaaaggtagcatccagaattaataatcttctccaacaaatttcattagtagtcagggaactgcaaattaaaatcaaagtaaaatactactttccactcattagactaaaatccattcaagtctgataatacctagtactgagttggagtaatagaaactgctaatgggacagttagttggtcatcactttggagagaaattagtcagtatctagtaaaagttagtgatacaccttccattttcatctgttctgtgctgctaccaaagaatacctgagactaggtaatttataaataatagaaatgtatttctaatggttctagaggctgagaagtccaagattgaagggccagcctctgcagagagccttcttgctgtgtcatgccatggcagaagggcaaagagagggcaagagagagcaaaagcaaattcacagcatcaatcccttttataatcagcattactctattaatgagggcaagaccctcatggcctaatcacctctaaaaggtcacacctcttaatactattgcaatggtaattaagtttctaatacatactttttgggagacattttcaaactatagcacctaccctatagcccaacatttctactcctaggagtatgccctagagaaattctgcataaatatctaaagagaggccattgttgcattgttaggtactggaaaattggaatcaattactatgtctaccagcagcagaagatggctttttaaaagttttggtttattcatgaaatggaatattgcataaagtatgctccatctcaccagatgaaaacatttttcactaggactatttcaaaagtagtcttatcactgggcttctctattatgcataaaaattttaagtgaacatgttctttgacctagtactcctacttttaggaatttgcccaaaagggacaattatactactgggataaatctttgaatcataaagtaagttgtaaatggtacaagcagtatgtcttatttttatttaaagcacattaacaatattacacatatagtaaaaaataaataaataaaacatgtgaataataaacacccaatttagaacaagtgttgacagtggagagggaaagagagagaaagaaggagaaatggggagtgggagcgggtacacaaggaaattttagttgcagctccaaatttttactttttacacaatgaagcgaatatggcaaaataagatttgttaaagttgggcagcaggtacacagatattctatcattatcctttgaatatttctgtagatttaagttgtccattaaaaaaataaaatacacacataatttttaagattagttttttctatttcctggccttcgcatgcactgttaactttacctggaattctttatgcagtaattaagagcaaaggtgtagagcaagactgcttgagcttggatcccagcactgagttgatttagggagaataacttaatctcttaatcccaagagaaaatatgatataatagttttgagctcataaagttttcataagcattaaatgtgacctatatatgtaaagcaatctaacagtgcctatagtatttataagtgtctgcattaccaaattcatcattatcatggcatgtcatgtcaccatccactacattaccatcactgtcaccatcatcatcatcaccaccaccatcatcattaactccctttgtctagtcaattcatatttgttcttcgtattttagatacctgttaaaatattttttcaaagatgtctactctgattcttcagtacaaatttgatttaataagatcctatcattttgtccaaatacttataaaaatttgtagttctatatttaatgtgttttgtttgtttaacatctctctcctacattgtgttaagttttttaaagagaaggtaagggttaaagagagacatagagagagaaagagagacagagagagagagagagcggttctacagcaatacaggtatattagaaaaacctgcaaaggtggggaccagcttaatgccagagccccccactgcttataggctggggtacttataggtctgggggtacttataggcctgggtgggtggggtctgagcagtatggcttgctgcccaagaagatgttgataagacgttcccatgatgaggcagtttggtccttgcttccatagagtgtgatgcttcttgcactttttcccagcagaatgtggtagggatgttccttcaggtgggcctttgcctggcagggtatgataaggatgttcctgtgccttggaatcaggtagttagacaggatgtttctcacagcctgaacccccatggaatgtttcactttgaccagggtctgcgaaatagcagggggcttacaaaatggtgtagtttggactaacaccttggaacacaaaagtttcttggggccaaggctggcgtattagtctgttttcatgctgctagtaaagacatacctgagactgggtaatttataaagagaaaagaggtttaatggactcacaattccacatggctggaggcctcacaatcatgagggaggcaaaggaggagcaaaggcacgtcttacatggtggtaggcaagagaacgtgtgcaggggaactgccctttataaaaccatcagatcttgtgatacttattcactatcaaaagaacagcacgggaaaaatctgcctccatgattcaattacctcccaccagattcctcccatgacatgtggtaattatgggaactacaattcaagatgaaatttgggtggggacacagtcaaaccatatcagctgggtatgttttattcacctttttatacccattgtcatgtcttctggacaaacaatggatgtaaaatggtatagactcctgagtactcatttgttgaatgacaaatctatgaaccatttgaccagtatgcagcagccattaaaattatgtttatgaataatttacagcatggaaaaatttggggttgctagtagaaaaacaaaaaggtacaaaaggatatatataataagcctacaatgccatataaacaatactaacagcaaaaacaaacctataaattgggggaagatggggcagatagaagtaacctaaaatactaacatgttgttttggggtcatgaaattataaatgattatgcaccccttaatttttactttctatgtttgatttttctatggtaaatgcatttttattgaggtggaattcacataacatgaaatgaaaaatttagtggcatttattatattcacaatattgtacaaccactagctctacttccaaaacattttcatcactccaaaataaaaccttgtacccattaagcagttactccccattatttcctctcttagctcctagcaaccaccaacctgctttctgtctctagggatttatttattctggatattccataaaaatggaggcacaatatgtaccttttatgtctggcttctttcaccaagcatgtttttgaggctaatccacattgcagcatgtatcagtacttcatttctttttatgaataactgtatacagaccacaatttgttatccattttttggtttatggacatttgggttgtttccatctctcaactattgtgaatagtgctgctatgtatatttgtgtacaagaatttggttacctattttcaattcttttatgtatatatctaagatgaaattgcagggttatatgctaatcctatgtttagcatttttttttaggaaccattaaactgttttccaaatctgatgccccattttatattcctactagcaatgtaagcaagttccaatttctccatatcctcaacaacacttgttattttctatttttgttatagccattctaatgagtgtaaagtgatatatcattgtggttttctttgcattttccttatgaacattgatgttgagtaccttttcatgtactttttggtcatttatatatcatctttggagaaatgcctcttcgtgtatgttttgcccattttaaaactagattgtctttgttgttgacatgcatgcattctttaaatattctgcatactaggcccttatcagatatatgatttgcaaatgttttttctcattttactggctgtcttttcactttattgataatgtcctttgatgcccaaaagttgtttattttgatgaagcatatttatcaatttatttcttttattgctcatgcttttgatgtcacctctaagaatttataaccaaatcagaggtaatgaaggtttacccctctattttcttctaagagttttatagttttgactcatttacttaggtcgctgattcatttttagttaatttttgcatatgatgtgaggaagaggtccaactttactcatttgcatgtggatattcagctgtgccagcaccatttgtgaagagtctatcatctcctcatttaataatagtattgacacctttgttgaaagtcaattgataataaatgtatgagtttatttctggaatctaaattctattccattgatctacatgtctatccttgtatcagtatcacactatcttgattactgtagatttgtagtaagttttgaaactagaaagtgtgagtactgcaatattcttctttttcttttttaaagattgtcagggcctcttgcaatttaatagggatatgaggattgacttttctattctacaaaattaaaattttgttagagattgcattgacactgtaggtagctttcagtaacattgccatctcaacaattttaagtattctaatacatgaatatgagctttctttctctttatttaggtcttctttaatttctttcagcagtgttttgtagttttggggtacaagtctttcacctttaaattttggtgaaatttattcctaggtattgcatttttttatgctattgtaaataaaattattttctcaatttcctgttggatgttcattgcaggtgtatagaaactcaactgattctttgtgttgatcttatgctgagaccagctcagttggggagaccctaacctagaagcactagaggaattaaagacacaaacacagaaatatagaggtgtaaagtgggaaatcaggcgtctcacagccttcagagctgagagcttcaaacagagatttacccacatatttattaacagcaagccagtcattagcattgtttctatagatattagattaactaaaagtatcccttatgggaaacgaagggaagggctgaaataaagggatgggttgggctagttatctgcagcaggagcatgtccttaagtcatagatcactcatgctattgtttgtggtttaagaatgcctttaagcggttttctgccctgtgtgggacaggtgttccttgccctcattccggtaagcccacaaccttccagcgtgggcattatggccatcatgaacatgtcacggtgctgcagcggtttttatggccagttttggggccagtttatggccagattttggggggcctgttcccaacaatcttataccttgcaattttgctgaatttgcttgttaactttgatagtttttttgaggattatttgggattttctacatatcatgtcatctgtgaataaagatagttttgcttctttctttctcatttggatgccttttatttccttttcttgcctaatttccctggctagaacttccagtatgatgttgaataaccatggtgaaatgggcattcttgtctttttcctgatgttagagagaaatttttcagtctttaaccattgagtataatgttagctgtgggttttttacaaatatcttttatcatgttgaggaagttccttcctactcctacttcttggagtgtttttgatataaagggtatttaatttgtcaaatgctttttctgtgtcagttgagattatcatgtgagattttttttccttcattctattagtgttgatgttacattggttgattttttatgttgtactacatttgcattctttatataaatttcacttggtcatggtgtataacccttttaatatgccattggatttagtttgctagtattttgtttagagtttttgcatctatattcataagcaatatcagtccacaggttttttgtggtttatttgtctggctttgctataatggtaatgctgtcttcttagaatgaatgagggagtgttttctcctctttcattttttaaacgtttgagaaggagtgatattaatttttctttaaatgtttggtagaacttaccagtgaagccgtctggttcttaacatttttctgtgttgggaggtttctgattaccaatttgatctctttaatttttacagatcttttcagattttctatttcttcttgagtaactttttagcaatttatgtattttagaaatttgttcatttaatctaggttatttaatttattggtgtgcattttttcatagtattatcttataatcttttaatttttgtaaagttgataatgtccccaccttacctgatcttagttatttgtgtcttctctgtattctttttgtcttcttcttctgtcttagcatagctaaaggtttgtcaactttgttgatcttttaaagagtcaacttttgctttcagcatgcattactttttaaatagaaatatatacacctaagttgcattacaaaggagttgtcctccacacacttattctttcccaccatcagaggtttatggtccccgcaaaagtcaccatcagttgggctcaactccaatcagtcatggtaggtcagggtccatctcattgtctccatcactcatgcccacccagggtaagtctaatcatgttcaccaatcagaacctctgccacatcagctctgtgggtttcctctcatgccatctgtaccaacaatgagcacagtctgggtttcctgatgttttctatagcatggtgcccctccctgggacacctcagaagccacaatgatattcattaaacttcttcctgcaagtactccctctattgctccttctactcaccaagcttagtgtcagggaatatgctggtggggagtatgaatcttagcttctcactcccagactcggctcccaacctgctgttgccaagtcttggggacatctataaatgccttctaaatacctgtcttggcctatccccagccacagattcctccctagagcaggctacctctgaggcatctatactgagatcttaatcacagagacatttaaaacatctaggctacaaaagaattcctactatagggttcaaatgaatttctttccgtcacttgagacagctttttagcaagtacatgtattaaagattctgatttccccttttttctcctacagtttgtttggcctaaaggtatgacatctaatctgctgcatttacactctaagtcaaaattaccattttgttcttttaatttctatttctaatcatacattcttgtctactcctggttcatctggagacaaagttgaacttagaagatggaggagaaattcttatctgccctctgctagttgacacttcctttccaagaatcatttgcagttgctgggctttcttgctgtgactctatgccctgttgtgttactttttcatttgtgacaaaaacagtggtaatagtttgcttcatttttattatgaagacttgaccaggataggtaggaacataattactgctttttctgtgggcatcatattggtccagatcatgtttaaccagaattgaagatgtaaaatcctagaactcactaatctattttagtaggtcacaggaagcatgcaaaccataaaaaccgcaatgaaccaaaagcatctgtgttgacaagaggcaagaatttctctattttctaaaggcactaactgaacaaatctattgcccattacttaggaaattgctaagggcatcgttaaagtacttcaggctgttgaaaaaccttttctgtcttcttgccccaccaccaattctctctagctatgctttctctcacatgttcttgccatccatggagtggcagagaggttctgagtacaactctaactttcagtttcaatggcctaatccccaactcaactgctgaccttgagtgtaaaaataaacaagatcttaaacatcttagggccagcattctgggtcttcttttgttatttggggagcataaactattctcatatcattggcttgcagaaaaattgagcttctcctcttccttgccccatgtcaccttgaggtgaccacagccctgccttctatgtaatcctgcttggtcagcaggcacatcagagctcagtggcttgtgacatactttccttcaagcctgctcgaagggccatactcatcattgagactgggaaccttagaaaccatgaacccagtgccaatgggtagatacagaattctcaaactcatgaaaaaacatcctttttaactctctccgtgtgcataaagaattctaagatgtactgatcaagattcccaattttctaactatctattaatatatggacgaggtaagaagaaagttgcaagaaaaaaatttgtttgacttgacggttgtgtggttatttgccacactcccccagatccactctgagtcccaggatgctgattttaggggctacattgcctagactgtccattattccctcttcccatctggttcagtcactgggaagcactggtaggaggtcagagtgggagaaggaggttaggatactttctgcccctgctgtcctactgctttgctgaacttctagcagtggctgagccatcaacctgcagctctcaattccagctgtctgtagcactcaagtggtattgtttattcttttgatccttctagctgttaaggaagaaaaaaataattttttcctcaatgctcataagttcttggaatggacccctgtaacaaaagacagattaacacgagaaaagtttattaacgtacatattttatacgtacataggagctatccagggaatgaataattcttaaaaaggtgactttgaattccagctcatatagcatcttcaacaaagttcagtaacattttagagatatgacaagacaaagaaaatgaactttgagcctctagggacagtgacttgtaggaaggcaaaaggaataaatggaggtaaaggctggttagtaatacttgttaatgaagattcctctggtgccatctccaggtccacaaggatttaaatttgtcttcagtggtgaacctttgttcaccctggcagaaggtgtggaggggggtgcagatccgttttgtctttgtaagtctatatcctgcttttagacaaataaagggagggaaaagagctttccttcatctgcttcttaattgccttcagctcaacaatccttatgcaaaagaggtacattttagggtgtcaaattctggtctcccacaaagcatagggatgacagaccacctcaccatccctgttgcttcttttaagcctgctcacccctccaaaaatattttcattctatactgtctcttcaaaatctcagcggagggtgccctctgttatcctgccctctgtgtcagtataagccaaaggtttgaatcctggctctgcaactatctacctctgtgcctctccttgtttatgaaattacagggctggagacaaagatcacaatgtgaagacaaaattggagagcggtcctaatcagccagagcaaaatttctggctcttgctcttccccatcctgggttgaatcataggaacaggtggcaagatgccagggtcaggagattccagaagtggcagcaagctcagtgttaccaggtcagggatgacctgtcttattattgaaatctcagagatatgctccaattccggcccagagacacattgagagacaactggggaacttgctatgttcctgaacaggcaatgagctgtcttccaagaaaaaacctgagacccttcaagtctcaggtcttacttagcacatataccaggtcttacacaggacacatggttacaactgactgaaatctgggctgggtgtaggagctcacacctgtaatcccagcccttcaggaggctgaggcaggcagattgcctgagcccaggagttcgagaccagcccgggcaacatgacaaaaccccatctctacaaaaaatagtcaggcatggtggcatgcacctgtagtctcagctacttgggaggctgagatgagaggattgcttgaggttgagactgcagtgaagcatgatcatgccaccgcactccagcctaggcaacagagcaagatcttgtcgcaaaagaaagcaaaaacacaacataacacaacaacaacaacaacaacaacaacagcaaaaaagccaacttcttgaaatctggaaaggacacctggactgccctgagcatttgattgttgttggctctagcagtggatgcatccttcaacctctggcactctgcagggctcagactgttctgttctgtttgttacctgtggagtgcctgccagaccctgctctagctgctttaggtccatttaccctcatagacccccagtcttgttattcatatttcatatttgggaaatggaaacttagaaacttgccaagtccacagcatgagatcctgcctccggtgtctgctggattccagaaagtgccaggggccaacttagatgacaccatgttctctgcacaatcttaggaatgctcctagtctgatgtccccattgcaaaatttacattatcttttaacaaaacgtctttccaaggaggggcatttaaaataactgaggttcttcttgctaaggacgttcctgacacaagagataatttagcatttccttttcattaaaaagtttgaaatcctgtaatttgtgataatgtggatgaacctagaggatgttaagtgaaataagccacacacagatagacaaataccacgtgatctcactcttatgtggaatttttttttaaataagttgcttagccgggcatgatggcacacacctgtaatcctagctactcaggaggctgaggtgggaggatggcttgaactcagaaggtggaggtagcagtgagctgagactgtgccagtgcactccggtctgggtgacagaatgaaacccaatttaaaaaaaaaaaaaaagttgctatcttagaaaaagacagtagagcagtggttaccagagactggggaggaaagagaggaggtgagaatgggcagcagttgatcaacgggtacaaagttaccatgagataggagaaacaagtgctggtgctctgctccaagtagggtgacggtagttaataatgaattctgtatatataaatagctagaagagagggttttcaatatcattattatttcaaaagaaatgataaatgtttcagaggatggatatgtaattaccctgatttgatcattgcacaatgtatacatgtagcaaaacatcacattgtgtcccataaatatatacaattattatgtgaattaaataaaaaaaaattttaaagtcttatctaaatgaaatttctaaccagattctgaatccatgataccactgaaaccagcacacatgatcgcagtaaaacctcattatacttcctccactatcaccaataccctttattctctggaacatgaaacattctgttgtgctcatatcatgcaaattatcactagtaggagagcagagagtggaaatgttccaggtataaagacccacaagataaagaagctcagagtcgttagaaacaggagcagatgtacagggtttgcctgactcacactcaaggttgcataagcaagatttcaaaattaatcctattctggagacctcaacccaatgtacaatgttcctgactggaaaagaagaactatatttttctgattttttttttcaaatctttaccattagttgccctgtatctccgccttcactttctgcaggaaactttatttcctacttctgcatgccaagtttctacctctagatctgtttggttcagttgctgagaagcctgacataccaggactgcctgagacaagccacaagctggtgagttgtaggcattttttccattactttctgattcataggctcaacgcacctcaaagctggaaatgccgggtctgggtacaccctggggaactgcaaagcctgcacacttgggggaaatgatcaagatgagaggcaggggtggggatggcatgtgcaccaggagatgttagagaaaccctgaggaagagcagcgtgcagcaggtgatgggggagagtgggcagcaagcgaggccaggacagccactctgctcagtcaccagtccacacacccaggggctcactctgcccctctgagcacccaaggacgttaaagagctggaactgttagtctaaatataggaccatccaagctctgaaccaaaatgtgtcccttgcctcaactcaggagatccacagaggcagaagtaaggaatttattttctgaaagatagatttctatcagttctgggtgacatgttctgacacttgaaatgacacctaggacagcacatttcaggcatcttgctcattgttcactgtagtagaagctacatgctagccagttgtaaaaatgaaattaagtaatgtgtgcacagcatttaacatagcatctgagcttcaggagcactcaattaatgaccacagttgtgattctttaggcagatgcatttttttccaactttgatcagaggtcttatttagcttctccagatttcaagaatctggctcagtgatatgaaatacaagacttgtgaaaagtgtcaattgcaagagaaatggaaggataaagtatacaggtgggtggaaaagaaattcacagtcactgccagaaaaaaaattcttgagaatcaagtcctgatgatgttagggcttatagttcttattataaagagttttatgtactcattcagtgaacatttattggtgcctcctttagccaggtactatcataagagctgaaaataaaagcataatccagtccttgatcttgaggaacatgctgtgtgtagcagataacataataagtgcttatctagatgcatgcagtgttatgtgataagagtaatatgacagaggatacagattaggcttcacagagaagggggatttgagcaggaggtattgaagggtgaatagaagctcaccaatcattttgggcagaggggcaaggacctgcaaaaccactgaagcatgaaggaaatggtgagtttagggaaaatgaagagaagatggctgtgactgaagcacaggatttgggattggagaagggactggaggtgaggctgagaagaggcaaactcagaaaagatgttgtgctgggcagtctggacattatctttgaagcccaccacatataagtcatagggctactggaggttttaagctaaaagtgactattcaatttcaacttaagagaagataggttgagagggaacatggcttgagatgagccatgagcaaaggaaagactacaacaaagccaggagtgaggagtgtgtgaagcaagaaagtgacagttgaaagcagtgcagaggggatgaatctgagaggcatctatgaggtggaactcaaatgacatgataataatacagggcatttctctgtgtcagatgctgtcctaagtccttactccattgatcttcacagcaactcagcatagttaatattttatgcataaagaaatcggcacttgaaggagtaattggccccagattacactgcctataaggattcaaatccaggtttgtttggctccaaaaactggctcctaattttcagaaggagaagcgacccagggcaatgcccaattttgcttcttaggcaatggaggaatccacaatcggaaggagttttcagcagtgccccatttggggtgggttgaatttgaggtccctgcatgatacccactttgctcacttcagtgcctaaaactgagtatggttcatagtaggtgttcaataagtgttgatgcagtgaatacatgcatggggagatatgcatcaggcaatgggaaattcaactctaaggcttaggggaaagctggagcttgaagacagagctttagaaaacagtagcatagaagggagtaggaaccatgagtttagacaatacaattcaggaagaactttgtagcaaggataaagaggcaaaaaattaaagaggtgagagctaagtgtggtgcctggggaatcttaaggtgtgggcacggggaggagatgccagcaaagaacatgaataaaaagcggtagcacagcccctcccatctggaagccaaaaagaattgtaaatggaggaagttagcagaaggatcaaatacttgaagagggtggaattggaataaaaccagggcatttgaaaaattgggttgtcactgcaatcttaacaagagaagttttggcaggatgatggaggcagaaagctgagagaatcatcagttagaacgtttttgacttcagagaacagaaaatgcagttcataatggctttaaaacaggggcttgtttttctcccagcaatttgagaggccaaggcgggtgcatcaggaggtcaagagaccgagaccatcctggccaacatggtgaatccccatctctactaaaaatacaaaaattagcggggcatggtggtgcacgcctatagtcccatctactcaggaggctgaggcaggagaatcacttgaacccaggaggtggaggttgcagtgagctgagatcatggccactgcactatagcctggagacacagcgagactccgtctccaaaaaaaaaaaaaaagaaggcagaaggtgaatagttcaagggtgggtttaggactcagtgataataggattctgcctggcttctcatggttctctaggtcttccattcatggcaccatgccctcactaggcatgctgccagagcaggaggggcaggtggagggttctcttgtgtctgtcttatcagggaagaagagctttctcagaagcccccagcagactcccttttcatattatggtccagcaatgagtcacagacctatgcaccacctgcaaaggagccagagaaaacaaacgcccagcgcttttagcctgaaaatgagaatctggtttgctggggaagataaagggtgtcggaaaatggctgttgggtaaatcattgatgtctgccactaggaatgaaaggcaaatcaggaactggcacacatgctttcagggagatggctgcaagggagagggcaaagactgggaagttgcttatgtggtgccagactatttggaagatcatggattgcggtgtttgtgttgtgtggtcatcattttgttctttgtttacagaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataacattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggtttataaaacgaggagcagtttgattgttgtttataaagggagataacaatctgtatataacaacaaacttcaagggtttgttgaacaatagaaacctgtaaagcaggtgcccaggaacctcagggctgtgtgtactaatacagactatgtcacccaatgcatatccaacatgtgctcagggaataatccagaaaaactgtgggtagagactttgactctccagaaagctcatctcagctcctgaaaaatgcctcattaccttgtgctaatcctctttttctagtcttcataatttcttcactcaatctctgattctgtcaatgtcttgaaatcaagggccagctggaggtgaagaagagaatgtgacaggcacagatgaatgggagtgagggatagtggggtcagggctgagaggagaaggagggagacatgagcatggctgagcctggacaaagacaaaggtgagcaaagggctcacgcattcagccaggagatgatactggtccttagccccatctgccacgtgtatttaaccttgaagggttcaccaggtcagggagagtttgggaactgcaataacctgggagttttggtggagtccgatgattctcttttgcataagtgcatgacatatttttgctttattacagtttatctatggcacccatgcaccttacatttgaaatctatgaaatatcatgctccattgttcagatgcttcttaggccacatccccctgtctaaaaattcagaaaatttttgtttataaaagatgcattatctatgatatgctaatatatgtatatgcaatatatataggctcttgcttgatctctccaggaggtagtgattatgagaagggggtggagaatgatgagttccttcaccaggagcaaaggacggggatcgtgtggaaccactgcagaactatttccggaatcaactaagtggagagagccaggaaggctgcatcagaacccagtaaagcttcttgtctggatctgagctggtttgttttgtgcttgcttttccctgccttgccactcccctcactcttctcttttccccacagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaaattggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttgataaaagatttaaaaacaactggctgtttttttacactgtggtgtggaagattgtgttgtgttcacaacttttcacttcttcccctgtgtgattacacacacctgcccttgtggtgtgacttgcagtgcgccctacaggccacacaaccccatgccctccaccactggctctgctgctggaatgtgagcagaagtgacatctgcctcatccaagcagagcctcttgctcagccacaggaaggcccattccagatcacacccgtcagcccgtgcgccctggtgaatgagaagacacagggagctgcagccacatataacatgagcaagaagtctgtgtttgctgtgataagccactgagttttaggggttgtttgttaagaagcacaaaaaccgattaagacatgtggtatatagtgacttcatatatagaatctggaaaactatccatttattttcaatcatggaattcaatatgacaagcatcccggagggtctacctatgccagactgggttggaaacagaaagacagatgttaatgccagtgtcctttacacctccaagtccagggccagctgtggagtgggaggggtagagaaggtcctgtgcacagtcacagtgcgctgtgcagagcaggaacagaggcatctgtgaaaagtgctgagagcctggaggacagagtgactaatgcaatgacagtcttgcatcataggaataacagccacagcaggattttattgctgccaaagaaactgccatttaaaaattgccagccatccgggaggctgaggcaggagaatggcatgaatccaggaggcggagcttgcagtgagccgagatcgggccactgcactccagcctgggcaacagagccagactccatctcaaaaaaaaaaaaaaatgccagccatctctctttctaaagtggaatcctcaagtctcgtttattctggggacatttgagtaggctgttcgagttaagcaggtggaagttgatgatccctcatcatcattctgagggatgagtgtctgaagactttttggtaaggaagggtcttggcatagcccaccccatgccacctcccttgatctgtgatatccccagcagctggggaggttggagcattttgcaaagaggccccgaagcctccagaaagtaaaccttcaagagcccatccttccttcctcttttgtttttgctcattatgaaaacttccctgacaaattgaaaaggcttcaggtgagattagcccacaggaaaaaccaccaagggccacccagaggggccacactgtgacagaaggagtatgggctggtgagctgacctctggaagacagtgcatgaattgaggagaagagattggttccaggcatgggaggaatgaggctggaaatttcttcagacattgccacttcggcactctgtgtgtgtgtgtgtgtgtgtgtgtgtgtgtgtgtgtgtgtgtgtgtgtgtgtaaacagagtcctgtaatgcaaggtccggccttggcagccccagcctggagccacagtgagatgtgagctgagggttatgctgggaaaaacctctccctcccagcacctgaaaggctctgcaggcccagcagctcagcaagcaagggtaagggcatggactaacatcttatttcatactatcccttataacacatcctaatgtaatcagctcacaatatgaaattatttcatttctctccagtcattgtttcaatggggccttagggttgactggattctggaggtccctgcctagaggagggggtgcattctgtccctatgtcccctcctgctccatcctccacagcacgtgcctagtggtctaccttgtggggaattcttgtacctccctcttctaggcatggactagcattgagaagtgggagaggagtgttaggaaaaagggcaaatatagacataccttgtcttattgtgctttacagatattgtttttgttgttgttgttgttgtttacaaattgaaggtttgtggcaaccctgcctcgagcaagtctattggtgctgtttttccaacagcatgtgcttgttttacatctctgtgtcacattttggtaattctcccaatatttcaaactttgtcattatttctatatctgttatggtaatctgtgatcagtgatctttgatgtcactattgtagttgttttggggcaccatgaagtgcacccatgtaagatggcaaacaatcaataaatgttgtgtgtgttctgactgctccatggactgcctgttcctgagacacaataatgtatatataacaattatatatatatatatttataacaattatatatatatatattttttttttttttttgaggcagagtcgcactctgattgcccaggctggagtgcaatgatgtgatttcagctcactgcaacctctgcctccccaggctcaggtgattctcccacttcagcctcccaagctgggactacaggtgtgcaccatcacacccggctaattttttttttgtatttttaggagagacagggttttgccatgttgcccaggctggccttaaactcctagactcaaacaatccacctgcctcagcttcccaaagggctgggattacaggcatgagccactgtgcccagcccaagacacaataatattgaaattaagccaattaataaccctacaatggcctctaagtgttcaagtgaagggaaaagtcccacgtctctcactttaaatcaaaatctagaaatgattaagcttagtaaggaggacatattgaaagtcaaggccaaaagctcacctctgcaccagttagccaaattgcgacttcacaggaaaagttcttgaaggatatttaagctctactccagggaacatgcaaatgaagagaaaacaaagcagccatattgctaatatggagaaagtttgagtggtctggagaaaagatccaaccagccacaacatttccttaagtcaaagcctaatccagagcaagactctaactctcttcaatgctatgaaggcggagagaggtgaggaagctgcagaagaaaagtttgaagctagcggaggttggtttgtgaggtttaatgaaagacaacatctccataacataaaaatgcaagatgaagcagcaagtgcaaagggagaagctgtggcaagttatccagaaaatctagataagataattgatgaaagtgtctacacgaaacaacagattttcagtgtagacaaaacagtcttatgttggaagaagatgccatccaggactttcacagctagagaggagatgtcaaggcaagctgcaaagctccacaggacaggctgactctctttttagaggtgaatgcagctgatgactttaagttgaagtaaatgttcatttactattttgtaaatcctggtgtcattaagaattatgcgaaatctactctatctgtgctccataaatggaacaataaagcctggatgacaacacatctgtttacagcatggtttactgaatatttcaagcccactattgagaactattgctcagaaaaaaagattcctttcaaaatattactgctctgcaccatgtcgatcaagagctgtgttggagatgtacgagaatattcatgttgttttcatccctgctaacacaaacatccattctgcagtccatggaccaagactttcaagtcttattaagaaatatatttcataaggctattaagaaatagctatatatatatatatatatagccttatatagtttatatagctaccattgatagtgattccattgatggatctgagcaaagcaaattgaaaagcttctggaaagtagtcattattctagatgccattaggaacatttgtaattcatgggaggaggtcaaaataccaacattaacaggagtgtgaaagacattgattccaacccccatagatgactttcaggggttcacgtcttcagtggaggaagttgctgtagatgtggtggaaacagcaagagaactagaactagaagtggagcctgaagttgtgactgaattgccgcactctcatgatcaaacttgaacagatgaagagttgcttcttacatatgagcagtgaaagtggtctcttgagatggaatctcctcctggtgaagatgctgtgaacacggttaaaatgacaacaatcgatttagaatattacataaatttagttaataaagcagtggcagggtttgagaggattgactccaattttgaaagaagtgggtaaaatgctatcaaatagcatcacatggtatggagaaatcttttgtgaagggaagagtcgaccaaggtggcaaattgcattgtcatcttattttaagaaattgccacagccacccccagctttagcaaccaccaccctgatcagtaagcagccatcaacatcaaaacaagaccgccatcctcttcagcaaaaacactatgacttgctgaaggctcagatgatggttagcatttttagcaatacaatatttttaattaaggtatgcacattggtttttctgacataatactattgcatacttaatagactacagtataggataaacacaacttttatatgcactgggaaaccaaaaaggttatttttgagatatttgctttactgtggtggtctgaagctgaactcacaatctcaccaaggtgtgcctgaacctctttagctaactggccactgccacagtccactctgtgttggtcaagatgccccagagtggcaggcacactgtgtggtcacatccaagggcctagatatggtgggggctccaaatggatctagatatgtgagatctctctttgatttgacttcttccaacccaccattttctgggtgctgggctcatctcacccagaaagtaggacccaatgtgacagttcctgcccagttccctcctgtggtagccacttgacccaggggcactcttgatccttgcagcctcacttacacaccctatctctacccctattaactctctccaatccccactccccctgctcagcttgtctgctgcccagtgggggccccacccatgctggcctctccttttgcaagtccccattcctcatatggtttcttcagagcccctttctttggctttgaggagagatgccctcactcgcttccccaccaatcctgcccacttctacaatccattcattatcctaattgcctccgtatacagactggagtgagaggagttgatgtgatgggtgtggatacagggctggtgctgtcatcttctagtaagccctgggagaggtgtctgagcccaggtgtcagtggttttctttggaactgtgagtgcataacacttctttgccttcagccttaggccatagttgctagttctgggacaaccagaaaagccctacataatctcgtgttatgtgcagagctgagtatagagctccaggtatgatctgactcacttaagatcacagtgagtctattgtattgttgaactgttagcttagacatctgttactgtacctacatggcactagcctcacgcctagacaccgatctgaaagaaatcccctaaatgcatagagaagacttctcagctgagctaaggggctcccaccaggtttgagcctatctaatgaatccatgaggtagacagcctgcacatgtccacttggtttgatgaattgcacaaatccctatgggggatgtggttcatgggctgggaagtgggttaccctgggaaaggtctacaggacagaggcagggatggagacaacagcatggtgagttcccaacccacccacgatgataggtgtctgaggcagaaggtaaagaggctgtcacctggtgggtgtcataagactcaagtgtcattgttgaggcacatgggtaacaaagcgtggcactggatgggggtagattcttcctatttctgtgaggatcagggggactccctggctctcctgctaaaggtggctctagggacaggaagagtgtacttcttgacagggatgtcagagcactgatggtgacaatcagtgtgacactgctcacatgactgaacaaccgagaagagcccgactgtctactgaacaacgggaagagcccgactgtcaatgacggagctctgttaaatatagttaaggctattttgttgaatgaatgaagccagacaggaaagaggacagtatctttaatccatttatagaagttaaagacaggcttatttaatctctatgaagacagagtggcccttacctctgggtggagcaaaaggcaccttctgaagtgatagggatgttccttatcatcttgatccggagtggtagttacatgcatgtatgcatatcaaaactcaccaagctgtaccactaagtgtgttcttcctcaataaaaataataaagaactacacttataaagaattttttaataatataggaaaatgtctacactataatctttagctaaaaaaaaaaaaaaagaagccgcctacagaatggtatatgcatgagaacaattaatcgaaaagtgcatgggaaaagtcaggattgaaacatcatgttttaaaagacattgttttgatactgtgagaatgtacctaagtttttccttttttctgtttttcccaattttatacaatgagcatgtgttggttttataattagacattttgtttgtttggtttggttttgagacacagcttgctgtcacccaggttggagtgcaatggcccaatcttggttcactgcaacctccatctcctgggttcaagagattctcccacttcagcctcctgagtagctgggactataggggcgcaccaccacatccagctaattttgtgtatttttagtagagatggggtttcaccatgctggccaggttggtctcaaactcctgacctcaagttatccactcgccttggcttcccaaagtgctgggattataggcatgagccaccgcacttggcctagacatttgtttttaaaaataaaagattcatttgctctttttacagcccgtctcactgttgactgatattgaccaggagtcaactcaggccccagggattttcacaacagctgctgtatggcagggtttctgctcactgtgctcatgtagttggcccttgcacccaaagtgaataattaacattctccccatcctgttgacgatgctctgaaaatatggtccagaaatggtgtgagcaaggagacagcaaagcaatgcttggaacataggtgcagtgactagacatggggcagctgtttaaagacaaaaaggccccaaaaaggagggatggcacgaaacaccctccaatatgggcatggagtctagagtgacaaagtgatcaaaagttcatttcctatggggtgtccgaatgtacttaataataaaaagagaacaagagccatgcaaactgagagggacaaagtagaaagagtagcagacaccaagcaactaagtcacagcatgataagctgctagcttgttgtcattattgtatccagaacaacatttcatttaaatgctgaagaatttcccatgggtccccactttcttgtgaatccttgggctgaacccccctgtcctgagtggttactagaacacacctctggaccagaaacacaaaagtggagtaacacacactgcaaagctgtgcttccttgtttcagcctgtgaatcctcaccttgtttcccatctagcctatatttttcaaactaacttggccatagaatcatgtagtatttagggtggaagctgccccaggtctagcacgtcatttaacagatgaggaaatggaagcttgggcagtggaagtatcttgccgaggtcacacagcaagtcagcagcacagcgtgtgtgactccgagcctgctccgctagcccacattgccctctgggggtgagtatgtcttcacatcctccaataccctaatgacagacaaacagaacatggcaaagcctcagctctgcatggtgaaagtaagaaccagcaattgccacaaacagaaatacagtgttggtccggcagcctccgggggttctgcacaagtggattaccagtgaatacaaggctatctatctttcgaaaaaccaacgttgtatttatgctattttctataaaattttatattaatttatttgttacctatttttgaactctttcaaaagcacactttatatttccctgcttaaacagtcccccgagggtgggtgcccaaaaggctctacacttgttatcattccctctccaccacaggcatattgagtaagtttgtatttgggtttttttaaaacctccactctacagttaagaaaactaaggcacagagcttcaataatttggtcagagccaagtagcagtaatgaagctggaggttaaacccagcagcatgactgcagttcttaatcaatgccttttgaattgcacatatgggatgaactagaacattttctcgatgattcgctgtccttgttatgattatgttactgagctctgttgtagcacagacatatgtccctatatggggcggggttgggggtgtcttgatcgctgggctatttctatactgttctggcttttcccaagcagtcatttctttctattctccaagcaccagcaattagctttaccttttcagcttctagtttgctgaaactaatctgctatagacagagactccggtgaaccaattttattaggatttgatcaaataaactctctctgacaaaggactgctgaaagagtaactaagagtttgatgtttactgagtgcatagtatgtgctagatgctggccgtggatgcctcatagaatcctcccaacaactcatgaaatgactactgtcattcagcccaatacccagacgagaaagctgagggtaagacaggtttcaagcttggcagtctgactacagaggccactggcttagcccctgggttagtctgcctctgtaggattgggggcacgtaattttgctgtttggggtctcatttgccttcttagagatcacaagccaaagctttttattctagagccaaggtcacggaagcccagagggcatcttgtggctcgggagtagctctctgctgtcttctcagctctgctgacaatacttgagattttcagatgtcaccaaccaccaagagagcttgatatgactgtatatagtatagtcataaagaacctgaacttgaccatatacttatgtcatgtggaaaatttctcatagcttcagatagattatatctggagtgaagaatcctgccacctatgtatctggcatagtgtgagtcctcataaatgcttactggtttgaagggcaacaaaatagtgaacagagtgaaaatccccactaagatcctgggtccagaaaaagatgggaaacctgtttagctcacccgtgagcccatagttaaaactctttagacaacaggttttttccgtttacagagaacaataatattgggtggtgagcatctgtgtgggggttggggtgggataggggatacggggagagtggagaaaaagggggcacagggttaatgtgaagtccaggatccccctctacatttaaagttggtttaagttggctttaattaatagcaactcttaagataatcagaattttcttaaccttttagccttactgttgaaaagccctgtgatcttgtacaaatcatttgcttcttggatagtaatttcttttactaaaatgtgggcttttgactagatgaatgtaaatgttcttctagctctgatatcctttattctttatattttctaacagattctgtgtagtgggatgagcagagaacaaaaacaaaataatccagtgagaaaagcccgtaaataaactttcagaccagagatctattctctagcttattttaagctcaacttaaaaggaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccggtaagtaacctctcagctgcttggcctgttagttagcttctgagatgagtaaaagactttacaggaaacccatagaagacatttggcaaacaccaagtgctcatacaattatcttaaaatataatctttaagataaggaaagggtcacagtttggaatgagtttcagacggttataacatcaaagatacaaaacatgattgtgagtgaaagactttaaagggagcaatagtattttaataactaacaatccttacctctcaaaagaaagatttgcagagagatgagtcttagctgaaatcttgaaatcttatcttctgctaaggagaactaaaccctctccagtgagatgccttctgaatatgtgcccacaagaagttgtgtctaagtctggttctcttttttctttttcctccagacaagagggaagcctaaaaatggtcaaaattaatattaaattacaaacgccaaataaaattttcctctaatatatcagtttcatggcacagttagtatataattctttatggttcaaaattaaaaatgagcttttctaggggcttctctcagctgcctagtctaaggtgcagggagtttgagactcacagggtttaataagagaaaattctcagctagagcagctgaacttaaatagactaggcaagacagctggttataagactaaactacccagaatgcatgacattcatctgtggtggcagacgaaacattttttattatattatttcttgggtatgtatgacaactcttaattgtggcaactcaaactacaaacacaaacttcacagaaaatgtgaggattttacaattggctgttgtcatctatgaccttccctgggacttgggcacccggccatttcactctgactacatcatgtcaccaaacatctgatggtcttgccttttaattctctttttgaggactgagagggagggtagcatggtagttaagagtgcaggcttcccgcattcaaaatcggttgcttactagctgtgtggctttgagcaagttactcaccctctctgtgcttcaaggtccttgtctgcaaaatgtgaaaaatatttcctgcctcataaggttgccctaaggattaaatgaatgaatgggtatgatgcttagaacagtgattggcatccagtatgtgccctcgaggcctcttaattattactggcttgctcatagtgcatgttctttgtgggctaactctagcgtcaataaaaatgttaagactgagttgcagctgggcatggtggctcatgcctgtaatcccagcattctaggaggctgaggcaggaggatcgcttgagcccaggagttcgagaccagcctgggcaacatagtgtgatcttgtatctataaaaataaacaaaattagcttggtgtggtggcgcctgtagtccccagccacttggaggggtgaggtgagaggattgcttgagcccgggatgatccaggctgcagtgagccatgatcgtgccactgcactccagcctgggcgacagagtgagaccctgtctcacaacaacaacagcaacaaaaaggctgagctgcaccatgcttgacccagtttcttaaaattgttgtcaaagcttcattcactccatggtgctatagagcacaagattttatttggtgagatggtgctttcatgaattcccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttggtttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctttctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataattcattatattcttgctctttcagtcaagtgtacatttagagaatagcacataaaactgccagagcattttataagcagctgttttcttccttagtgtgtgtgcatgtgtgtgtgatgtatacaaagagagagataattgtatttttgtattttcttttaaataatttttaaaattgacccttttcctgagacaaattgccagaatagtttgtatttagagatggtacctctaagagtaaggttgctggttgctgagcaattgacttgaaaacttttaaaattcaaattttaattccactactcaaaagaattgccatgttttaaaaaagagaattggtgccataagttagttgtctatgtttgaaaatgaagaagatatgcaacgtcatggcctggtcacttacccgcagccctgagttgtaggcacatcatatgtgagaatgaggatgcttttctttcatttaaaatccctccccaaaacttggctctaattgcagtcatgacaatcatgtacatttggatttatgtgcacgagtctcttaccctgagagaggacaggtgctacaggtggaggggacccgtctgggtcacgttcacattttgaacatgctggttttcagtcactgcacactcatctcccagcgcaggtcatgggcagcagatgcaaaagctgcccgtggtcctatttggaggtgcatgaaatgagcagaagacagaatagcttgatctgactagaagggcagcttgtccctaccaagacttgaaggattgcctttcatctgttagggtaaaaggtagaatgaaccaaggaagggcaggagggggctggggttagggtagaaggaaggggccatggagaagggagatccatcccataggaggaaggcagtgcggcagggaggtttgaaggtatcagcttttgtggctgacatacatgcagtcatgtcaattgctcgtttttccttttccatcttattaaatgtcttccaatgttagcacgaagaaaagctatttgcagtgttgccagcctttccagagcccgtccccattacctccccaggcccatgcctttactccttggagtttcaactcacgaccttcaggatctgactttattcaccaactctggggtgaacgtaccttctgtctccacccagaggtctctatcaaagaggagattgcatgccatggataaagtcaaagtagaggtgactgtccttaggaagagtaatgtgaaaattcataaactgggattctgtttacattttgtactccaggggttcttagtttaaatcgctctgaataaattaagatgcaatggcatttcaactgttatgattaaatttacaaatcatttattttctatcacggggagagatagagctccaaatgcaaacataactgctcaagtgttaacacttataatgaaaacataagaattaccaccaactaccctgggggctagaagcagaaatgtgaaccagaaaacaaatcatgaactttcctttttttttttgagatggagtctcgctctgttgcccaggctggagtgcaatggtgcgatctcggctcactgcaaccactgcctcccgggttcaagcaattctcctgcctcagcctcctgagtagctgggactacaggcatgcaccaccacgcctgggtaattttttgtatttttagtagagacagggtttcaccgtattagccaggatgctctcgatctcctgacctcgtgatctgcccgcctcggcctcccaccgaagtgctgggattacaggcatgagccactgtgcccggccaacaaatcatgaactttctaactgcagttccttgtagcttgttaacacatccacttacttattgtcagagtacgtggagattttccacaaccctcggggataaggctgaacagaagaggcaaaaacgtgaaaacatttcgatagctcctatactttgaaataaaattcactgtaaaagttgcttgtatttttccaaaacagagtcaacccttaatatttaagattctgtatacaaatacatatttttatataattaatatatattgtcatatgacatatatctttatattaatatgcatgcatataatatatatttccttcctaattttctataagcaattttacaagactgacttctatttgcctccttattgttactacgtggtttgataatccgttttgtgtcattgtgattctgtcatgttttggggacttatttttgtttctctgggtggtcactagtttttttaaagcattcatggaagagtgtgaatcttttacaagctaggaagccatggcaagccttgggtcatactgcccccgcgaggccacattggcaaaccagcaagggtgttcaacttccagacttggccatggagaagacatacgaggaggcttttcacattcagctctttaatgtttgtctctgccggcaccatcccagttgtgaataagaggtatttccacagcggctcagggtaggtagtgcacagctcacattcatcatttctgaaaaccgagaggagtctccattcggggtacaggttgatgcctgtcgtggaatgaaggttccaacacccagaccaatctctgcagtgtgctgctctcatgagcttgcaacaagatcagaaaatgttttgtgactaagcatttttcatattgcataaaatgcttcaagctcctcccttgtttctctctataatcctgtatatctgatgattgtgggtaccaagtgtttgaaataatcaaatgtgatttgatgttggtaaatttctttttttttttttttttacttctattttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccaccacagtccccaaagtgtgatattccccttcctatgtccatgtgatctcattgttcaattcccacctatgagtgagaatatgcggtgtttggttttttgttcttgcgatagtttactgagaatgatggtttccaatttcatccatgtccctacaaaggacatgaacatagcaaagacttggaaccaacccaaatgtccaacaatgatagactggattaagaaaatgtggcacatatacaccatggtaaatttctttatcattcgcactctcctttctctattattgttattgtaactgaaccgcagattagtcactcattgcttgcagaatccaattaacaagagcgaggtcagatataaagaaaatgatttattccaaacctccttcagggaagaggtgcagcctcctgcctctaaatgcactgcttcgccaggcgtggtggctcacacctgtaatcccagcactttgggagaccgaggagggcagatcacttaaggtcaggagttcaagaccggcctggccaatatagtgaaacccctgcctctactaaaaatacaaaaaattagccagacgtggtggcgggtgcttgtaatcccagctactcgggaggctgaggcaggagaatcgcttgaacctgggaggtggaagttgcagtgagctgacatctagccactgcactccagcctgggtgacagagtgagactctgtctcaaaataaataaataaataaataaataaataaatagtaaatgcactgctttgcttttggagcagaaagcaggcactttgaaaaggcaggggaggaagtgagcaagggcagggggtctgcacactggcatggtgcctgatctatccaggcagttgaattggcactttcataggcagaaataagttgaaaaagtggcctaaaactctctaggtgggagtggatagtgggcatgccttcaacctgcctttctggagggtgagttccatggcaaccccctgaagggtgagagttccatggagatcatgctttggtctgtaaatcagctgttaactctctagaaagttctgtcttggagcatatagttagatgaacttgccctgtaaagaatgtctggtgaaggggaagtaaaaggtgagatttgcatttctaaagggctaagtagaacgtggggtacaagaggaaaggagaaaagagaaaataatttaaaaaataattgtaacttattcccttttacttagaaaaaagggaatactcagttacattatcacctcgtttacatcaaaccctcttatggaatcctatggtttgaaaacaaaaaggttgttgaggaccagtgagcccaacccctttgctttataaatgaagagcattgcctgccctaagccccagagactctgatgtcgtgggtctggagtgggctccaacagcggcatgttttgatggtgcttcccagtggcacgccagcgatgagcctttgagtagggaaagtaggagcactcgtgactcccttcacgatcagcacctgtgtgctaataaattcacaaaagccaacatattggagtcactcagggagttttacaaatagtgaggttaaatccaacctcaaatagttctgattcgatctgcctgcattgctgccctgtggttccccactgtagaagctccccaggtgattctaagtgtagccaagtctgagaaatactgcctaaagcctgttggactgacagcaagggctgttgtctgagcaagactttgcctggcctggggtggcatgtgcaccaggaagagtctcaactttcataacagaacattccccaagctggtttttttaaagcatgtgaatctagacttcattggcaataccaaagatctgtatttgaggctccaagtatttcactttcatttttggttttgggttatgttttcacccttcctttccaagtgaaaagtaaacagaagtgggatgtctggcgcccatgctgagcttggcaacttcaaattcaatagagaagaagtctcttgtatagaaaagggcctgtctgagatgtttctcaaataaatatagattttgcttatgtggctaaaggattcttctccccccatttccttatccctgcagtgagccatccttcttaactctttccatgaaagcattattcctgaagaactgggaactcatgccagccctgatcaggcaatgataattctgcagagaattagaatttagatttaaattgtcaactcttatacatcctggcatatggtttaaacacatgtacacacacacaaacacctcctactatttactgaagagcagatatctgataacttaatctttttggttttgagtcaagacaattcctccttttgaaactgcataccgctgaatataataaaatgtaattaagattaaaaataagaaactaatgggagaatttcaatattgtctctgttcactttaaaattcctctacttaggtttactgccattaccaaagactattcaaaaatcctttttaggagaatcctaatggtttcctgacatataatcaaataaggactctgttgattggctaactcaatcttcctgtgccaaaaagcagagcccagcagagaagagggcagggacttgaaagtcagactgactcgagttccagccttggggctgtgggagcttgggcaagtgacttaacgtctctggctctcaggatctaaaaggatttccagtagtaatttggggtgttactgatacaggagctaaaaagaaattatttaggtggttagtgagggtcagagagtcctcggtaagatttgccttttaacaaaaagcagccccaaaatcatttgtttgctaacaaagagaagcctgtaaaattgagctgcagacatagataagcaagctggaagcttgcacgggtgaatgccggcagctgtgccaataggaaaaggctatctgggggccaggcatgttcaacatggattctccatcttcccttttctttgtcaaccaagtgtacagtaaaggaacaggcaacatggcacgggccaggtagagaacccttctgcataataaaagattagggtgagatggccagcttcttcccgtgctatgtaaatggcatacctggtccaaccagtcttttgggccctgtgtaaatcagacaccgcctcctcaagttagtctataaaaccccatgcattttaccgtgaaactgggagatccactcggaaccccctcctgcacgagagaccttttctcttttgcctattacacttccgctcttaaactcactgctcatgtgttagcatccttgatttccttggcatgaggcaatgaaccttgtgtattaccccatacaaatgatgctgcttcattactaatagcaacctgacagggttgtgttggggtataaattatctagaccagggagatccaatataatttttttgtaatgacgggaatgctttgtatctgcatcatccaaaatggtagccaccaggccagggtgaaatgtggccagtgtgactgaggaactgaatgttttccatgatttaatttaaatgtggccaatggctactgtaggagacagtgtgagtctggcatattataaataataaatattaatataatttgaactttggcatcagtgtttcctagatttgaattactatgcaagttgcttactgtttccaagcctcagctttctaatctgtaattggggctaataatagtatctgccttacaggtttgttcagaggataaatgagaaattgcatgttgagggcttaacacagtgcctggcacataaaagctctggtaacagttagccactttaataatttgctaataatggctatttcttcttcagattaggatgtgctcccccaaacagtgcacttagacatagcgggcaatccagctcactctctgcagtgagagagaagcactggccgaccagagtcagccaggggctcatgggtatgaaatcaacagcatgattttgtaagtaatggatggaaagggcctcacaactttatggcactgtgttcaatttgcttggtcttctgtagctccttttgaaagccttttagggtggattaacctgctaccaataattctggtcagatgtagactccatagctcaaagcaaactgagagagtgagggcagcaggccaattccccaccccttccttctggactctgacagaagcttacactcaaggaagagcaagtaggaattaacgtgttaagagctaggtaagcaaaacccaatgagaagttctggcaaagccccatgggcaggggtggcttaggcacaggaaacaagtaggatttcataccacgcgcctcagtctacttccggggccctcatcctcagctgtgcctatgcaaaggagagcaaccaataaaccccaccgccactctcctactgtggaggccagggatggccaggggtaagagagggatgggaagtgtttcctccagccgtcctctgagaaggagaggaaactgggcagagcttctgtcctccttcaagcagaaacagaaacaaaagaaacccctaagggggttcttacttcccctctagttcagttgtgcactaaccatctgcagctcaacattcagcattcattcattgattcagcaaacattgaaggagggccagctatgtgccagatgccaactcatgccatgaaagagagtccctgtccttatgaaattcactatttagagagaaaagcaagcaaaaaggcaaagtttgaaaagtactgttgaagtggcatcattgtctggggtgaatacctgaggtttgtggtctcacgccaagggaatcaaggactcaggcacacaagaagtgagtttaagagcagaggtttaataggcaaaagaaagagaaaaaagaatagctctcttgcctgcacagagagaggggcacctgagtggatcttcctgttttgtggtgaaatgcaaggcattttatagacgagcttgaggaagtggtgtctgatttacttaggacccgagagattggtcagaccaggtgtgatgtttacatagcatacaaagaagctggccatcccatcctaatcttttattacgcagacggggtctatacctggctggtgccatgttgtctgttccttactgtacacgtggttgacaaagaaaagggaagatgaagaatccatgttgaacatgcctggcccccagatagtcttttcctattggcacagctgccggcattcactcttgcaagcttccagattgcttatctatgtctgcagcccaattttacaggttgctctttgctagaaaagaaatgatttgggggctgcttttcattaaaaggaaaaccttaccaaggttaaaaagaaaaaaatttctttttaatgcctatgttactgtgaacagtgtcgggataaggctctgagagccagatgaggatgagttatccaatccaaggatgggggtctggaggaaaaaatcctagagagcattgctgcagttgaataaggattagttagaagctactgagtggagcataggagtaggaactcttatgcaaatgtgcagaggtgaaataaagcaaggtatagtccaggtgcctaaagtagcacagctgacttgagatagatgatagataggtagatagatggatagggtacatagatgatagatagatagatagatagatagatagatagatagatagatagacagacagacagacactggtgtgagtgtgggtgtgtgtgtctggctgcgtgcatgcattcctcctgcaggagatcaggagcagtgggcagtatggagtgacaagaagattgggaggtactccttctagccctcccctctgctctgccctccactggagcagaagcaaagcatatggtgaaggggaacaaggagtctccccagcacagtacccgagtgcattagctatttatcactccacagtccccattcacgtgttaattcagcatttattgaatgcttactgtttgcaatgtctatgtcaagctgtcaagtgtagtttttattctacaggccacaggcaccccctaactgtgttaaacaagatggtagtattgagacaggaataataagggtggtcacaggagaatggaagattccaggcagcagtttgactagtaaaaaaggaaactgttgaaatagctgcataatccaggggtcaataagaacctgagaaccagggtgtgagccaaggctggttaaaagcaactggatccaatatggtgctgagtttctcctaggttttgcctggaacctcattatatgctcaataacataccaaatcacacacccaccagggccattccatttcctggaacactcatgtttggtgtaaaaatgggtggcaccacagctctgagaaatctttacctttttcaggaaacttcatgaatattccatcctttggttaaagaaacccataatgtagaagccccaaaccctactgggcgcaactctctctctcttgagtatgcctgcacttccctttattatttatttatttatttattatttatttatttattttttagatggagtctggctctgtcacccaggctggagtgcagtggcgcagtctcagctcactgcaagctctgcctccagggttcaggccattctcctgcctcagcctcctgagcagcagggactacaggcgcccaccacaacgcctagctaattttttgtattttcagtagagatggggtttcaccatattttattttatttttgagacagggtctcactttgttggctcgctgcaacctctgcctcccaggctcaagcaatcctccaacctcagccccccaagtagctgggaggacagacgtgcaccaccacacctggctaatattttgtatttttttttgtagagacagggtcttgccatgttccccaggctggtcttgaactcctggactcaggtgatcagcctgcctccaccttccaaagtgctaggattacaggaatgagccaccccacccgaccacactcccatttcttgagtgtgtgcattttgctctgcaataaatctctctactttcacttttctctgactcgtccttgaattccttcttgtgacagcgtcaacagcctggacaccaggtgcagtcaacgtctcaccagtgtttagggacctcccctaatccactggtatcagcatgatcagacttgctttttcagaaaaagccttctgtccatagaccaaagggaagtgactcagagaaggggcaggaggaatcacaagctccctgcctgaccaggcctggactatggcagagacagtgagatggtgagaaagcaagggtagacagccagccaaatccagaatatagaaagttctacaggaaaaggtggggccaaggtgggacagggggaaaggaattgttgcacattaacagtgcaatgcagagcactggtcttgtttatgtccaggttagaacaaaccaatgagaaagcacatctttgagacaactggagaaatttgaacactgactagatataatattatgttaattatgctttaatttggggtacaataatgcttttgtagctatttctaaagagtccttatctcttaaggatacactctaaaatactagtggattaagttatatgatgtttagactctttttaaaataatccagtggggtgagaggcagagggaagggagaggagcatagaggaaacagtgttggccatatgtttgtaattgttaaaactgagtgatgggaatatggagatttaacatattaatactattttctgcccatgtaatatttgaatattttcataataaaattgagagagagataaagaaagaaaagagaaaagaagagaagagagaagagataagggaagtggaggaaaaagagctttcttcaaggaccattgtggtggacacaaatgaaagatacccccttcctactatgaattctaggtgtgtactacccaagatgagtcaatcggatcctagcttccagaaatcgtgagcatgatgcagccctacagacgcagtgccctggaaaggagacccatgaccatccaaggaagatgtcccatcacagaactgccctgggtcatgtgttttccaagtccacatgtccggtagttccttctttcctatgaccaatgccaccagtcttccagcactgtcctttattgctaggcaaacctgagccatcctcttcttcttgcaacttgtgcctgaagtaacatggacacaaagtccccacttttcccacattctcagaatgaagtagttctccctccacactttaggtgctagaggcaagtggattgcttgagctcaagagttcaagaccagcctgagcaacatggcaaaaccccgtctctacaaaaaatacaaaaattaactgggggtggtggtgtgcacctgcagtcccagctactcaggaggcagagaaggaggatttcttgagccctgaaggtggttgtgttacgtgcattcatgttaagagaccaccaaacaggctttgtgtgagcaattaagctttttaatcatgtgggtgcaggcagactgagtctgaaaaaagagtcagcaaagggagatagggatggggcggttttataggatttgtgtaggtagtggaaaattacagttaaagggggttgtcctcttgcgggtacaggcgggggtcacaaggtgctcagtggggagctcctgagatttattgtccaggagaaggaatgtcacaaggtcaactgatcagttagggtggggcaggaacaaattacaatggtggaatgtcatcagttaaggcaggaactgggtattttcacttctttgtggttcttcagttgcttcaggccatctggatgtataagcgcaggtcacaggggatatgatggcttagctcgggctcagaggcctgacattcctgtcttcttatattaataagaaaaacaaaacaaaatagtgatgaaatgttggggcagcgaaaatttttgggggtggtatggagagataatgggtgatgtttctcagggctgcttcaagcaggattaggggtgacacaggaacctagagagtgagagagattaaactgaagaaagattttgtggtaaggggtgatattgtggggttgttagaaagagcaattctcatatagaatgattggtaatggcctggatgcagttttgtatgaattgagaaactaaacggaagacacaaggtctgaataagagaaggagaaaaacaggcattaaaggactaagaactgggaggacccaggacatccaattagagagtgcccaagggggttcagcataattatttgcttggttggtgagtttttggtctccatccttgagttttttttatgttgtcatatgccaggccagattgatttaggtaaaaacaacactcttcatttaaaaatatacagagttctcctttctcagcagtgagtaagtcaaggcctcagcagttttggaggaaagagaaatgcaaaggaagcaattgtttgttaagaaggattagaaatggctaggagagagtgagtgagattgatagtgtggtggagatagctgaggagaggtagagggtggcataagaatgggaacgagaataagagtgagtataaaagtaaagaatagaacttcatcagggtgaaagtattggagggtgccctgtcagcaaagatcatctgtccactccaagagggagtcaagagtggcggattggggatagtaccaggagatatccactatgatggtttggaggaaaagtgtaaactggcagtgtaaacaggggcagggcatttatgagtcattgagaatggtgaataggagtatgactagacagaagatagtggagatgacaaattttgggggcacagtccaaatagtgggggtgactgcgtagagctctgttgcaaaaagtagggtaaggataaatagacttaatagaatgaagagatgtattaggctcataagggttattattgttcttcagaaatgcgagtgagtttaagggaagtaggggtgagtacttgcgacttccagaaggaagaggagagatcaggctggctgtctgatgggcacagctttattctggaacagtgaatccaatggggagggtcgtgcagacggatggcagttggggtgctataaatgaccaggtagggtccagtccatcaaagctgtagagtgtgaggggtcagacttgacaaggactgattgcccagctaaggtatcttcacatggctgggagtttggaggaggcaagagaagattagcagcctggcgaatttcctgtctagcctgctggaggactggaagataaaggcaacaggtcgtgggcctggatcctgtgtgaggactctagcagcacagccttgtatttcagctgtgtgtaaggaaaaaggatgggacgagtcggggagtgctagtgtgggagctgtctccaggtcctttttgagagagtgaaaggaagaatggggaaaagacttatggtctatgggattagttaaattaccctttgtgagctagtaaagtggtttgattaggatagcaaagcccggtatccaaagttggaaatatccaacaatgcctaagaaggaagggagttgttgtttggtggtgggggttggggtctgggagattaactgaacagagtctgcaggaagggtatgtgtatgttgatggagcattataccaagataggtaatgctaggggaagaaatttgtgcctcagagggcaatactttgtacccctttgagtaaagatgttgaagaagcaggctagtgtcctgctgggaagattggtaagaggggctgcaaagaagaagatcatcaacatattgaataaggtgggaggtagatgggtgaaaagaaagcagatcatgagaaagggcctggccaaagtaatgtgggctgtccctgaagccttggggtagaaaaatccaggtgagttgttgggactggtgggtgtcagagtcagtccaagtaaggcaaaaagaggctgggaggagggatgcaaggggatagtaaagaaggcatctttgaggtcgataacagaatagagttgtggaagggtgtattgaagataggagggtgtacgggtttggcactataggatggatgggaaggacgatttgatcaacaagacgaagatcctgaacaaacctgtaagacttgtccggtttctggacgggtaggataggggagttgtaaggagaatttgtaggctttaagaggccatgttgaaacaggcaggtgataacaggctttaacccttttaaagcctgctgtgggatgggatattggcattgagcggggtaagggtgattacattttaatgggatgataaggggtgcatgatcggttgccaaggtaggagtagaggtttcttatacttgtggattaaggtggggagatacaaggggaggatgtgaaacaggtcttgagttgggtaaaagtgcagcaaagagatgtggctgcagcccaggaatactcagggaagcagataatttggttaaaatgtctcagcctattaaggaagctggacaggtggggataactaaaaaagtgcataaaagaatgttgtccaagttggcaccagagtgggggagttttaagcggtttagaagcctcgccgacaatacccacaacagttatggaggcaagggaaacaggcccttgaaaagaaagtaatgtggagtgggtagcctccgtattgattaagaaggggacagacttaccctccactgtaagagttacccaaagcatctgtgatggtccaggaggcttctgaggtgatcaggcagtgtcagtcttcagctgctaagctgagaagatctgggaaggagtcagtcagagagccttgggccagagttccaggggctctgggagtggttgccaggcaagttgaacagtctgatttccagtggggtctcgcacagatgggacattccttggcccagtggccagatttccggcacttgaaggaagatcctgggggaggaggtcctggagaaatgcctggcccctgcagtttaggtgttttgaagttcttgtgtgctggagatgtggctggggtttctcttacagcggaggcaagtaattgcaactcagaaatatgttgtcacttggctgcctcttttctattattgtacaccttaaggcgagggtaattaaatcctgttgtggggtttgagggctggaatctaatttttggagctttttctaatgtcaggagcagattgggtaataaaatgcatattgagaataagacggccttctggcacctctgggtctagagaggtaaagtgtctaagggttgttgccaaacaggccatggactcagctgggttttcatatttgatgaaaaagagcctaaacgctaactgatttgggagaggtcagctaaagaaaaaggagcattaaccttgactatgcctttagctctagccacctctctaagaggaaattgttgggccggtgggggagggctagttgtggaacgaaactgtaagccagaccaggtgtgaggagagaaggtgaccaaaggtttatagggtaggggagcagaggctggggaagaattgggacctggctaggcctagcgaggaacagcctggggaggaggggagaaatcagatgggtccgtagaaaaggaggattcaaaggactcagagcttggggtggagactgaaggaacagacaggagagaaagaggaaagatttgggatgagtcacattgggagcagagactagagagggactgatgtgtaaagaatgcctggacgtcaggcacctcagaccatttgcccattttacgacaaaaattatctagatcttgtaggatggataaatcgaaagtgtcattctctggccacttggaactattgtcaagtttgtattggggccaagcagtattacagaagaaaataagatgtttaggtttttaaaagagtgcataaaagaatgttgtccaagtccatgcccttcttaatcaatatgggagctacccactccacattaccttcttttcaagggcctgtttcccttgcctccataactgttgtgggtattgatggccaggcttataagccccttaaaattaccccactctggtgccaacttggagaggtcaggtgttagtcaaaggtgttttaagttttaagaacacaggctaagggagaagaagggggaatgaagcgtggaaggttgcccatagtgaaagaggtaagtttaaagagaaaggtagagacatggagaaggggggaggtgagcagccctgggctgtcatgtgggttagcagccaaagctggtgtcccagcaattgacttaccaccaagggaatgtgggtgaatgaccaaggcaggcatccccccggtgatcagacaccaaatggaatgtgggtgaaagatcaaggtaggtgtccccatgatgatcagacaccaaaggaaggctgtcttcccaaatccatgatccatgttggagtttttgagttcatggataaaatgtgtctcctttgtctctactagagaggaaaaagaactggaatttgaaggacagggagattgaagggtagggagagaggctgaagaagagagtgaggagaccgcttacccggtttgaaattggtgagatgttccttgggctggtctgaggacctgaggtcgtaggtggatcttctcatggagtgagggtgaggagaggggaccaatctcccgaaggagtcaccctgtccggggtcttcggcaccaaatgttatgcgcatccatatgaagagaccaccaaacaggctttgtgtgagcaataaagctttttaatcatgtgggtgcaggcagactgagtctgaaaaaggagtcagcaatgggagttagggttggggtggttctataggatttgggtaggtaatggaaaattacagttaaagggggttgtcctcttgcaggcaagggcaggggtcacaaggtgctcggtggggagttcctgagactcactgtccagaaggaatgtcacaaggtcaattgatcagttggggtggggcaggaacaaattacaatggtggaatgtcatcagttaaggcaggagcggcctattttcacttcttttgtggttcttcagttgcttcaggcaatctggatgtatatgtgcaggtcacagaggatatgatggcttagcttggactcagaggcctgacaggttgctgcagtgagccaagatcacactactgcactcctgcctgggcaacagagccacaaaaaaaaaaaaaaagaaaagaaaagaaaaaaaaagaagaagaaaaaaaaattttttttccaccaagaatttagtaaaaaattatagggaaaagtgtcactaattcaagggaattgcactgaaaattattcattcattcaacagatatttattgagaagcaagtatgctggtgctagggttacaacagcgcacaaattcttgtattcaaggaatgaggtaagagtatgcagataggagccagagaggtcaagaggcaattgcaacatagagtgacacgtgctccagaacacataggagggcttccaggccccatgctgggctatcagagctggcttcctgcaggtggtgtggctcagctaaaacctgagaaccaagaatgagccttctgatatctcagggttaaatcggcacaaatgaaaccattttataaccaaacaacattttccctcctgaactgcactttttctagaacccatttaatccttcctaacatgttcaatccagccccgtgatttttcagtcaaatgcaagatgcgtaggattccttttctgttcagtgctccccagccaatctttttcccttctcccaccccacagttactaattccagcgtttcagttctcagcagaggatgacagttccaccaggagacatcagtgttatctggagacattttagttgtcccagctgagggcacagtgctgctggcatctagtgggtgaaggtcaggaatgcacctcaacatcctggaacactcaggacaatccccagcaacaaaaacctacccatccagaacatcaacagggctgtggctgaggagccctgctctagtgcttcctccttactgtatcctcatcaaggagggctctggggcatgtcaggggctgctacaggctcctggcagatttcggcgacttactccagacttgtggaacattcaggattcttagcatggccacaggagagtcaggctgtccacaagcactctctctttcttcacccactcattcctgtcactctaccatttccactgccttcccaaatgcccatcgtgagtcccaccaggggccagaacaccactctctcaagcctccccagtggcgcgtgcacacctggagaacatgtctcacatcccccagccagcgagacgtcctgagattccagcacttctcagtgtctttcccagcttgtttgtatctggaatggggtggggtctctcacacaggagaaattacaaggaaaagtgtacgtgacaggaatggaggaatttctgtggaaacggtgtgtgagaaaatgtaggaagaaagaaacttcaggaaatggtaagtggcatcttgagagcagaaagtgagaagggagcagaaagaaatggggctggaacctgggaaggagaggacaggtggggatggccttgcacaccgtgggcactgaggagtgtgggcccatggcatgggtggagaggagtttcaagatagggagtagattcctattttgaacttcggattgcccctggcgatgtggagactgtattggaagaaggcaagaatggaggagagcccctaggtggaggtttggcaatgctctctccagaatatagcagaggcctcttccaaggtaggaaagccctgactggagagaagttaatggctctgagggctcaagggaggacttggattatcaggacttttagggaggcatatgatcaaggcttgggtcttggcccattgaaatggggagcactggttttaggatgtgggtcaattagtttggttttcaggacaggctgagttggatatcctgggggacctccaggtggcagtgtcaggggaagctggatgtgctgacactgaactcagcagagtgactgagtagagatcgacatctggggtcacaggcagtggatgccgtaggggtggactcaatagctcaagcagaacccggaggaatgcaggcagcaaagggagccctaaagaacagtgaggagatgtgccaagaaagagccaaatccgggggattggctgtgggagagagggctgtgggagtaagaggaagtgtcagcaacgtcaaatgttgcagagacatagagtaaggtaagagtggaaaaaacatccatggaaccctgtgatgcaatcggaatgcagaaagactttgtaactcctgcctggtctcctcctctgcccactcatggcaaaggaatacaaagtaatgttccctccttccgcctagaaaagcacaacttctgcccccaagccctgggctctcctgagaggacaggaccagcctctgaagttgaaggtcctggttctgcccccaagccctgggctctcctgagaggacaggaccagcctctgaagttgaaggtcctggtttaccagatagggaaggggccctttccaagaccctttccagaaggtgtggctgagatgggaaccgtggactctgtgcagatgtaggagctggctccagtcaagtgctaggaggttgtgggtcctgggaaggaagaggctctggagcctctgtggagactctgggactgtccttgggggagacgtgagcaggaagaagcagggccttcacagtccccagcttaggggcctcaccacccagactgaagaccaggaccaaaccctttcctgcacagttacaatgtgtcatttaattttactaaagggaatattttttaaatgaggatgctactttgtgtattaatttttacctctattcataaaagaaacgtttcttatctatttaagatgattcatatcagaccagtgtctgcccaactcgactgaccctgtgaaaactgggcacttcacactccaatgatgatggatgagtccccagcagcatagtttaagggagtgagtgggcagtgtggcctcctgtgcacgtgacttcctccttcagtgtgcccacatgtgggttccacggtcttgtgacattgtggctttagaaatttctgtttccattttctatcattcagagtaaatgaaatttgcaggaaattcagaaccttccacctgtacagtggatactgtgagactctgcccagatgccctcttcaagccaatgcatctctccatgctcccactcccatagatgggaacagaggtgctggaactcagatctactcccctttctgggaactggagctgcctgcccaggcaatgcccccttcccagggatggctgagccaatgactggctaatgttggattgcagaggcctagcgccctcccctcaattcctaattccttgtaggaataactgaggcctcctctgtgaccacgtgggcagcttctccctctgcctggtcctgtcttgttctctcctttccaattgtgtctcctggaagccctccccacaagtctgctgcatacaactctccttctcagagagcctgagccctggattcccaggaatccagcctaaaatagtctggcatttggtttcaattttctctttcactaagactcagtcacaggtgctaataaataataaaatgtcaccaccttgaattctatcactctctcttttcttgccccatctctgacaagtaggtggtccctcaagaacctgaaaagcagacattaggaggaaaggaggagtgggggcaagaggcccacacctcacctggccggctcccatccatgcgcccttgactgaggtaacacctaccctgggaatccttcccctgcctctcgtgagccaggccgggtgctcttgggacagctcccactgctcctgtgtgctcccccagcttggcacatgactccctgaattatagtcagttccgtacctgaatctccctctagaatgccagtgccacgaggacagaggacggttccactttgttcactattttctccccagggtctggcaaagttcctgggacttgggagaggtgtccttcaggagcttggcagaagccaaacggcacacttaagtagggcaactgaggtgagtttaatgaaggattctatacaaaaatttggacaaggtatagggaggccacaatacacagtgcagtgcctggtgccagtgagagcagggcactattcccactgcaaggccagacagggcaaggggagggagctgcctgacaagagctgcccttacgtcaagggacacatcagcccactagaccccatcaggagggagccagggcctgactcccctgaccttgctctccaatcttctgcctaaaattccccatcagccaaacacaactgaaaactgaaagacaggggagcctgctgttaataaggtgagcttcccccagaataaagctgggtagagagtggagaatggatatggaagggcaaaaggaagatttataagacagtgggcactaaatatctatgagatgaataaaggaaccacattttacaacaaacggtcattgaaacgctactcaatggaaagagatcatttcggtcactgtctggtgcagacaaatcaaagcccacatgcatcaaaaaggccatgtccgtgtaactccgacacggggcagacagcaaggctgaagcctatggggtatgtggagccggaactgagagatcctgatgtaaatctagcacttgggaaaagggggactagaagaaattcacccacaggcagaggaaaacacaaacacttatctatttttgcctaggctttaagtggtatgggaaaaatctctgagactacaaatcctgtgcttcatgcacaggtttataataccctcaaaatggaagaccccaaaaccaggcgcggaaaattcatatcaggccattgatgccctcaatgttcccggctgaaacaaactcaaaactcctctggaaaggagtgctcccacttcaagccatgaaaagctactgcagagaaaataatccccagtcaagacacactcacattgaaactgcaaggcacacaaggaaatggatcaccttgagtgatagctggcagagctaataaacctctgtatacctctaagaagctccacgcactagtataacccttaaagatttgatgaaatcattactttattaaaattgtttttataaaaaatcaaaatccaaaaaaagcaacaaattttataccagagccaattcggtatatacaagggtgtcttactcttttggaatttgtcttattgtcctaactcagcacattgtcctggtctatgaaaagtcctagaaacccttctaccctctgtaatgtaggagctttaactcaatagggttttttaaattcttttttcttgtctttttttcttttttaattttttccattttttcaagtcaaactgaagaaatatttttcttttctttctaggaatgcatattcaccccccaaggccacttgtctcctgattggagagtattagacaattctcaggatttctttattttccttctttattccataggattgggaaacccagtaggattgggtttaggcatatctctaaagcaccatgtttcaacgttttgatgtaagattgtgccctatttcttgttcagttgctgccagcagatgttatagttttaaaactagtttttggtcattgagatattagaggagggaagagtctgctatcctgctttactcatcttcatctacactacactgtcatcttcactgcaaagtcctgtattaatgtttttagattctataacattttaacaggtgtcaaaaaatcttaagcaccacttcagcttgggaatctctaaatgtaatggtgtttgtgggctggactgatgtctgcgtcttgttgttgttattgtctgtagtaatggagagccgggagatcctggacacttcctgttcatgggcacttgatgcattagctgccccagcagctgattacatttaaacaaggatgtgtgggtgaacccagggagaccaatctcagtggaatggtgggggcagaagccaggctgcagggtgtagagtagggaatgagcagtgatgaagtagaaacagagtttggacaactagtgaaactgcctggaagagggggagaagagacagtaaatggtctgaccaatgtttgaggtcaaagtgggtttgtaatctttatttaagggacagatctgagcatttaaaaattctgaataatctaatagagaggaaaaagttgggactcaaagaaaatgtgggaaaaaatgatgaaggttaaacggaatgagatccagagtgcagggggagagattagcctttggtgttagaggagcaactctgtccatggagagaggaaaaatgtagacataccacagttgcatttgaagttggggcctgaggagttgaggagttctgagaaaagcagaagatgagatcatttcctgagagtaaatgggagtcattagaacgggggtgaagagactggaagctttaggtagcttgaaatagttgatggaaaaattggataaagtgacaatttgtcacactcagaacagctatcagggaatctagaagaatctctggaagctagttgaagatcttaaattaccaatgtatcttgtccacatagctaagcggttttacttatttttatttttttgaaacagggtctcactctgtcacacaggctggagtgtagtagtagtagcacaatcacagctcaatgcaatctctgcctcccgggctcaagcaatcctcccaccccagcctcccgggcctgggactacagacacacaccaccactcccagctatattttgtacatttgtagagacagggtctcgccatgttgcccaagctggtcttgaactcctgggctcaagtaatctgcccacctcggcctcccaaagtgctgggattacaagcttgagcccggctgctaagtggttttaaacagctgttctcggaaacacacactcaaagaaaaaatgtagaggataatttatctaaggctggggcttcaagagaggtcagggtgttgacaagagaatgactaagtggcagactactggatctcagctagataaagagggatgtgatcgtgggaggggctgatagtcagaggctggaaggcttgatgaacaacacatattacacaaagaataaatggagtgagagaaaccaaaggagtaaaagttgtcatcagaaaagtgagaaattttattgtgagaattcagtggtaaatcaatgttaacaaacctcagctgggcactagtggagtgaaaccgaaggccagggagttgagttaatgagctgagacttgggcaccagatgggggtccacatggacaactaagccaccaggatgatgtgggaaactggggtgaatagaagccccttatccatgtgcacaagtcttgaataaaataggggcaaccaggcagtcagtggatgatagcagtgaggtggagcagagagcaatgtagttggagaagtggagcccacagcagtctcctttatatctagaagggaattaatagccaaaaaatggcaccgaggccaaggatgtcaccttctgactcccaaatctgagacagatgtgagagggaaggagtatcctcaagggacaggagatggtgcgaatgtttttggcataaatcaaagatgtcagggaaattgtcagaattcaggttccagagacacagaggaaaagcgtgggagaaagtggaatattgggaggtgagattagggcagaggaagcacaaatcaaagaacgaggaatagaaaaagtcatatgagctgaggagttggccaaacatgacagaatgggaatatgatggaattaagtggctttatgtgttccaaaaggattggtccacgcaggccacaggaaaatgggaggtaagaagaaagggatcgaaatgctgcaaagtgtattacttcatggtaagcaaaggactcaagactctagaaaatgatgcccttccttccaagactatgttagtccaaatctttcaagatacagaacccaaggtggggtctggcatacaagaagtataatagaggaaatgtctgtgacatttgcaggactgcaaagggagccaggagaagctgggaaagccatgagatcacaagcaggtctgactccaagtgaaggagatggggaatgacgcaaggtttggctgaagcatgtgccaaaggcacccatcagaggagtccctctccaagggatgggcctatcatagtgtccctaatagtgtcatggagtgggagcagcccacggagggcacagccttggcatgaacgcagacatgggtctcagagtgcagcagctgggcccctcagtcaattaggctccctcagagctggggcaggaggtgcactagaccacacagtaatatttatttattattaatttaattaataatattaatttattaatttaattaataatatatttatttatttattattactagaccacacagtagtatttgtatgtctaaggaagcatttctcagaatatactcactgaacttttagcctataagtacctgtatgaaaattttaaaaggggtttcatgatcaaaacattttgggaaacactccataccctttcttcctcatgaaggatcataatgcctattagtatatgaagggctctgagaagtcctgtagtaaagaaacttgctttagttttttagtccagcaatttttcaaacttaaatgagcaatagcctcccatccttttttttacactttttagcatactgcggaataaactcaacatgcattgagaaagactgctttagggaatagtcaacactatttcactcccagtaagtacatataaaatctgtatttccagggtggattatcaacacagctgtattttagaaatattatctgccctcccaggtatcacagctactaattattgggtactgaggtggaattttagggatcagccaattatgggaaagaaaatctgggggcaggataagatggtctccgaagccttaaaattatatgccattatttacctctttgatctactactcaatatcaaacaactaattcagaagaaaattgattgttttctaaaagtagtttttctacatttcccattaagaagcagtggtatttaaaacttataatggctattatgtgagattatcactatcatagtttttctctatacaaattttctgtaacattttatttgctaataaaaattagatagatggattgactaattgataatctaagaaagattatatttgaagaagccatagtaagggacagattaaattatcatcagtctaaacattctaatacctatttctctttttttgaaattttccaaatttgttattatgcatttaaacaataattttttgaacttttattttaggttctggggtacatgtgaaagcttgttacataggtaaccttttgtcatgagggtttgttgtacaaattatttcatcactcagctatcaagcccagtactcaataggtatcttttctgctcctctccctcctcccaccctccagtctcaagtagacctcggtgtctgttgttcccttctttgagttcatgtgttctcatcatttagctcccacttataagtgagaatacaaggtatttggttttctgttcctgtgttagtttgctaagggtaatagcctccagctccattcgtgtttccacaaaaaaacatgatctcgttcttttcatggctgcatagtattccatggtgtatatgtaccacactttctttatctaatctgtcattgatgggcatttaggtttattccatgtctttgctactgtgaatagtgctgcaatgaacattcacatgcgtgtgtcttcatggtagaatgatttatattcctctgggtgtatacccagtaatgggatttctgtttttagctctttgatctaatacctatttctcaagatcaagttagatctctaaaaaaggcatcatcctagcatttccccatcccttccctgaactaaatttaatgttgtgtgtatcaatcagcatacagtcaagacagaaaccacacatgaacattaaatataatgagttattaacttataaaagggtatgaactactaaagggggtaaggagaatgctgaagaatgcaggaatggcagatgtagagagcagccataacctctaagctaaggcacagcagccaaggaaggggcgaactcaaaaaatgccctccctccccagctgatccacccttgttggagggggtgtggctgcaacccaatggatgcccaagaagtttgcagagttgtggcaggttggggctgctgagcaggaaactgcccgaaggggtaccagtgagattcccaagaatgtgggcatgcctctggcgaggaagacgctcttggagtgccagcaaaatttactaggaagctacccagtagggtgccagcaaaagtcagcaggaagccactgtcgtggtgtcggcaaaattcactgaggagtgggcactgcagggtctccacccagcactggcaaatcagccaaaagaacaaaaacaaaataaaaacaaatcccagaaccagaaagaaaaaactctgcctcttactgcgaccctcttatgccttctacagcaactggcaaaggagaaatgtttatggggtccagctctagactcacaaagcagaacacagaagagtgaatgaagagctgaaaggcgataaatcagtaactggagcctcacatcctttgccttttttattgagggtcaatatattaagaagaatatgtctgcgtcttcggtaaaattattgctaaggttatcacccagtgtgtgttttcaacctccctgatataagaacttagtgacaagaaagaatgagacaatgatcatgaactattggacccaaccatttgtggctttagtgcccatcttctcagcaaggctttctctctctctctctctctctctctctctctctcttttttttttttttttttttttttaagatggagtctcactctgtcacccaggccggagtgcagtggcacaatcttggctcacggcaacctccacctcctgggttcgagtgattctcctgcttcagcctcccgagtagctgggattacgggcacccatcgccacccctcctggctaatttttgtatttttagtagagatgaagttttgccatgtcggccaggctgttctcaaactcctgacctcaagtgatccacccacctcagcctcccaaagtgctgggattacaggcatgagccaccacagccagctctcagcaaggctttttctgactacactatttaaaatgtgatccctgagccaccttggcctctcttgctgtccttccctgcttcgccttctccatagcacttctctcctactaatctacaatttacttgagctctgtgaaggtcaggatttttgcctattttgtccattggtgcatccccagcacctggaacagagctaggcacaggctaggcactctagaaatacttgctgaataattgaattaagtaaatgagtgatctacacgtagtggggaatgagagtatacagtgatagttccttcgactaaaactggggtcaaattatagtgataaagaggaactcagaccttcagaggtaagctttgtggaccacttgccaaggctgcagaatgtgatgtcgtttcacaaacaaggaggccctattatggcttcagatatgagaataataaagagaactttcctttcgcctcaactgcagccttctaaactcttccttccttcctatgtagaagtttcaaggacctcatggcctgagtgtggataggcagaatgctgggaatcaggcaaaaataaaataatactgaaagtgaaggtcatgctaatattagtaagccagggtgatcctgaatttacaaaacatttttctttgggaaatttcacacctcacatgattctgtgtttttacttgggaaatttcacatctcacatgactctgtgacatgcggtacatgaggtgcctgactgctgtttttgtcctctactaatgaggaagagtgtgcgtactcccagcgttttgcaagtttcaaagtctgacttgactttccttccttttcctggaactgatccatgagtatcgagagtaaagctgcccgcacctactcattcaagatcctgagtgtcctgcccagctgcaggaggtggagagacccaggaggaggggccactgctgatcccaggctgtagggggtgggaagagtgtcccagggcaccatgacccccactcactcactcacaggagacccacacaagagaggagagggcacttacagcttaggttcccaccagcaccaactcctctgccatcaaacatcattgtgtttctctttctgccttgtctgtcggcacacgtggagttaaatttaatgctcaatcacatatttgtctgggctctttctgtgtttatttttctcttaatagttctctctcctcccttcctctccccgcccctcctcctccttcttcttttttttttccagagacagtgtctcgctctgccacccaggccagagtgcagagtggcatgatcatggctcaccgcagcctccaactcctgggctcacgtgaacatcccaccttggcctctggaatgtctgggattacaggcacttgccactgcatctggctaatttttatattgtttatagatccgggatctcactatgttgcccaggctggcctcaaactcctgggctcaagcgaccctcccacctcatacttctgagtagctggggctgtaggaatgcgcctcagtgccaggctagtttcttaattttctatttctattttgacaggtacaaattttgtattcaatcctacctcagacacatctttggtgggaaaaggatgtcatttaatcaatatataaattctaagcaaataggtctgatccccaaattaggttagtcacagctgctgagtcgttgacccaagagaagctcatctagattttttcattattttcaagttcctcttctcggttcgtccttcttccagaccatgccctccccgtcccactctcttcccacagcctcccctccccacagcctcctcccaccattccaaatctgggctgttctctcaatttccttctctctggactcaaacctaccctagcccccagcctcagtttggggttaaacttgtcctcctcacattctctcccacccaacttgatgtcgcctctgtgtcatcaccacgggattttcctcctctgggttctccttttccgagtggggtcagctcccccatgagtcacagcaccaatcacttctggctgcttgcaaacccctttgctttcctcagtgttgacacccagggcagccctatgctcactgccgctgagaccccacctctgcccctggccttttcccagctgacatcaccctgtggcttccattttcctaaaattctcttttgaggcctcagtcttaaccaaagcacacagtgcccctcaaaaatgacaataaaaacccaaacacaccgtgactgtcatggcaggttcctggtccccgtattgaatcagcgggtgggtttctgcgaacactggtgagaggccgcattagagggtcaggaccctcaggtctggactcgtggtcaccacataccttcctccctgctgacagtagctggtacctgttacctactcagagtgtcacatgccacaagccagagcgtcttggcagttctcagcaccttgacatcacttccttgctaccactcagagcggcagtgacacagttcccttatctcagaaggccagaagacggctgtcaaaggtcacagggaaatcaaaggcggggtacagggccagagggaggaggaaacaacttcccggttgctttcagacgcttcagagatcctctggaggcctgggggagcttttgagtactttatttcagttggtccctgagctcggtgagtggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcccctgcaggagctcagcccagtggtaagtcatctgtgtgtcatctatgtatttaaccccttatggccatgttgatgctgagcatggtttcacttttgcaaacatttatttatacccttcgagagaaaaacgtctcagctgtcacaggaagctgcttcggggggtgagcaaactttttaaaatgcagaaattatgatctacacccgtttcttaaaagtaagccatcgtacttggttctctttaattatatattttcttacatattgtgttcatgtaggcaagtcctgtttctgctaaaagaaggtaagttctaccaaggcggtgtcatgccagctttatttcccgtggcacctggcacactgctaagcacttacatgcttaacaactagattgggaatggtgctgctctggggaagtgggcacacgttaaagaaatgtttatttcagtcttctgaaatagggaattactctggctaaaatgtagctccagaaagggaaagtggggctgtatgaatccaggtccagtttgttgtttcctccaggataaggcagctgtcggaggggaaaatcatctcccatttctccacagggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggcaactttttctcagccaggaggagggtgccctgtggcatcattacaagtgtcctggcatgggtaacagccattctggccactttgcctgaatacgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctatttaatgtattttaaaataatttgtaagttgattttaaaaccaatttaactacattccaaattatagacagcccatttatatgggagtaacttttcaggctcattgcctcgccggtgatgagaagaactagctagctggaagctgtgggaaaaagaggtaaggtaacttgttctgtcgaagttctctaaattctcttgcttacttgccacacccctaggcccccagcttcccctaacccaaggtttctggtattttctcgtactttatcaagactatggaatcttaggagacttaacaaaagcaaatgagaaattatgtttagaaatgtctaacaaaatgaattctttgtccttttaagtataacacatacctcaggcctcaccagcacataactacaaaaggttgtcccacttcctttctgtggctgagttagtagaacacaggctcccacctgccacatcagcagaaggtcacctcaacatgtgagctacctccccggagaccccccagatccgtaaggatgatgcatccttgatcctaaaaacattttcctgttcctggtgttcagaattggactccacactcactggtctctttataatcttgcttctggccctttgaggcctcaaagctaccagggccttgctgccaggggacaatcaccgctcccggctgagtcctgcagacatagggcctgggctggctgcctcctcctgctggcccagcatcttgcttgcactaaagagagctggaggcttggcactgatgcttgctaaaaacctacccaggccgcccactgctgccgcactgcagggcaccagcccacactcctcccctcctggcatcaggcacacgttcacggcactaaaccttacaggaaagcagtggaaccctgtctttccttcacaggaggcactttccttcctaggcaaaaacgatgatacccatgggcacagcatctcacatagggacacatagagatgtctgactcattaaaacccaagtctctggccaattaaaaggggtccttaatgtcctactcaacagtggtggaaggaaatttgctctatattgatgaaatgaggtggagaaaatctgattttccaaacatgagaattctccatatgccaccccataaccaaagaccccttatttgtgttagatgaaacattcaaagagcctattaggatagcggatgagacccccaagggacatgcttatacaacaataactggctccaaaccacactccatggcagtggctctcaaatgccagctcacatcacaagccctgtgctaaaacacagagttctgggccccatcccggagtttgtggttcaggaggtctggagtgtgacctcagaatatgcatttctaacaaattccccaggggatgcagatactgctgacccaaggccctccttctgagaaccactgttccagggagaagaaactcagctaagtaagggtttggctttgtgctgaagacaatgtggaatttagagttggggtgaattattcaggaaagtagagaggtttggagatgtgagggtgggaagcgcagtggagggaggcagagaggaaatatgaagcagcgtcagttggagagaaattaggaagaggaataaaatgatatatgccagggatttcagttttgctgagcccatgatgacagactcttctctggcaccttatgccactcattgagggcttgtagctggctctgctctttcagagtcataatagggctatgggtctgacctcaaggtgagctggaatgggcacaagtaatagataaaactgcaagaagtcactcaagggtccttcctagaacaaaggatccctacattccaaaggcgaatgccggtcactatcataaaagaaaagaaagaaagaaactgatggtgacattttaaatggcaatttttctagcttctaaaaggttgtggagcaactggaactttcataccctgctggtgggaatgtaaaatggtataatcactttggaaaaattggcagtgtcaccaaaagcaaagcctatacctactatccatttcactcctcagtatttacccaagagaaatgagcatgtatgtccatacaaagatttggacccaaatgttcatgacagccttatttatatagcctcaaactagaaaaagtctgtctatcaacaggtgaatggataaacaaatactggcctgtgtatctaatggaatactgctcatccacaaaaagaaacgagctattgatacacacaggagcatgcacgaaatctcaaaatgctgaatgaaggaggccagattttaattttatttttaattatttatttatttatttatttttgagacagagtctcgctctgtcacccagcctggaatgcaatggtgtgatcttggctgactgcaacctctgcctcctgagttcaagcaattctcatgcctcagcctcccaagtagctgtgactacagtcatgcacaagagcaactgactaatttttgtaattttagtagagacggggttttgccatgttggccagctgctctcacactcctgacctcaggtgatccacctgcctcggcctcctaaagtgctgggattacaggcatgagtcaccgtgcccagccggaagccagatattttttaaaagtacttattttgtgattctatttatataaaattctagaaaatgcaaacaaatccatagcgacagcaaatcagtggttgctggagatgttggaggggagaggagaggaatagattgcaaaggggaacaaggaaattcggggggacagtggatatgtctgctattttgactgtggtgatggtttcattggtatatacatatgtcaaaaacgtaacaagttgtatacgtgatttattatgtgttgactatacctcaaaaaggctattttttaaaatccccctcaggctccaggcactccattacgttggtgtgacttgtcttggaaatatactttgagcatttgccggaggagatccagtgcctgggcctctgtttcttctcccaagtagaattggcagctaaaacgggatgcccatgggcacaacttgtcacccccatcaccgaacagggagcagaaggaggctgctgggggtgcccccacagggagcacagtctcatcgggaatgacctgccatggcaaataaaatcaccagggcaagtcaagggagagaccagggaagagagtgatccagtctatattaaaaaaggatgagaaaggttgaagaaaaagagaagaagggacagaaattctcttcacacatttgcagaagtaggtccggactctccatccacttctcctcctccgataggtaggacaggaatctcagaggaaatggcatcatcttcccatgtttacagacacagcaatgaactcaaagaacaatcttatcaggattttccaaatgaaaacatggagcatatagagaataaagatccataaactcgtatggtggctgagactgaaatggttaatgaaaagcaaaagtgtgtgctgaatgacaccagccacaatggcctgaacacttaagtagtgtaatatacttggaacattgacagctaacaaggtcttcctcccatgtcagaccaagaacacagtttcctaaagataaaaatagcacatgcttttccacttttccataagtgactgcattagaaaactaacaaaccatgaaaagcaaaatatggctagtctcttcaagaaaaactggtgtttctattttgtctgtaaattactttctaatacaaaaaacaattcctgttacattgaggtaattctaactagggacatatgagagagagattgaaatctcatgagctgtctccttttcatctcaattctgtgtactcgtgggtacaaatggaactagtttttgtttgtttgtttgttttttgagatggagtcttgcgctgttgcccaggctggagtgcaaaggtgtgatctcggctcactgcaacctctgcctcctgggttcaagcaattctcctgcctcagcctcctgaatagctgagattacaggcgcctgccaccatgcctgactaattttttttttgtttgtattttttagtagagacagggtttcaccatgttggtcaggctggtctcaaactcctgacctcaggtgatccacccacctcggcctcccaaagtgctgggattacaggcgtgagccactgcacctggcccggaactagttttaaaacaggaaacagttgatatactgaatggaaaaacaatacaatttgaagttgaaaaaacaaaataagatgcccagttaaatttaaatttcagttaagcagctaatagttatttagtataagtacaacccatatacgacaattgcagtatttgttatttatctgaaattcagacttacctgggcatcctagtatcctgttttttgttttgttttgtttttccctttgttttcttttttttccccgaaatctgaccaccttaactttaaggtatttattcatttttaaaaactaaatatttttcggcagtcagaactagagcaaagataaatgatcccaggactctgtttagcaggcagtcaggaagtgtgacagtgtggtgggtggcagccccggccaggcctttcctcttccctaaactgccacagcaggactgccacacttgggaatcccagtttccatctgagcagcccctccagagtttggaaggagtcagtgctttagcctgaggagccgtggatggctctaacactttgcttgtcggttgaataaaaatcaacccaaaggtggcctacactcattgaagtaggaatgccagaacttcagtggtgtcacatagaagaaaatatctaagtgcttagggagatggcagtgctagtggatctactggatcattaagactcactcacccacccagcgcaggtctagaggacacacccttgccacactgggaagtgtaaatgagctccagcatctttatttttttttattttttatttgttttattatactttaagttttagggtacacgtgcacaaagtgcaggtttgttacatatgtatacatgtgccatgttggtgtgctgcacccattaactcgtcatttaacattaggtatatctcctaatgctatccctccccccgcccccggtgtgtgatgtcccccttcctgtgtccatgtgttcttattgttcaattcccacctatgagtgagaacatggggtgtttggttttttgtccttgtgatagtttgctgagaatgatggtttccagcttcatccatgtcccgcatctttaaaaaaaaaaaaaaatctctaagtggtggctcttctctgtagatcaggagctgtagtgagcaatgctacaaaactggagtttctaaatacaggggggatggtgggattctgaggaaggacaggccacgtggtaacacttacaaaagaccaagtgggtgtggttgccactgtggacggtggagccaaagcagtcctcagaatagtctgacccccagaggtctttggcattggctggttgatcatggtgtccctggaattgaaatagaaggacggtctactaaatttttacctgatctgtataagcagaagagttctatctctagtgaacagaagtctaactttagtcaccagaactgagagtcaattcaatcaattcccagatttgacatagtttatagacctagaaccccttgaatgaaaggtaagctggctccccttgaggaaggaccctgttacatttccggcattttattctgataatcttttttcccagccttccccaaagcaacttagggccatttaccagggaaagccatggaggaaaaggaaataattaggctatttggagattccaggacactggctctacgctgacaccagttctaagagacccaaaatatctttgtggtctaccagccaaagtagggcttcatagaggtcaggggtcactagagtttgagctcaggtctgtttcactgtgagtctagagggtccctgaacttatcctatagttattcccccagttccagaatgcagaattgagctgagagcagtggctcatgcttgtagtcccaacactctgggaggcgaaggtgagaggatcacttgagccaagcggtttgagaccagcctgggaaatatagtgagaccccatcttttaaaaagacaaagaaaaataaagaaaattgacatggaaaaataatataaaatgtgaataatctcacatctactaaagaaattcaatctgtaattagaactcctcccacagagaactataagcccagtgcccccatcaactggagaaacagaaagaaacaatcttcttaacagaaagcataattggaatagagatactctgcatcggggaagaatccccatattgattctctgatccatagagtgaaggccaagtggaagcctttggaactccctctacctgccaagatactaaacaaaacaacactgcacgtctggaggaattgtagcaagaacttgaaagatgaaggatgatgatgtccacctctctccattcagctcacctatctggtttgtgcagaagacaaataggtgttggaaaatgacagtggaccagtgtaaacttaatcaggcgggggctccagctgcagctgcaggatcaggtgttgtttcatttctgcagctaatcaacccttctcctggcacctggtgtgcagatggcaatttttcttttctattatctgttagtaaagactatcagaagctgtttattttcagttggcaaggtcagcaatacactccaagggaagagcagtctgtctcagatcttaccgatgcctggggatagggagggagtggccccctcaccgtctccaaggcctagtcctctgctcctgctactggcagcaaatccacgcaggtctgcaacaacctcaattcctgcctcctcagaagaaagaattcaattgagggacgtaagacagaaggagagactgaggcaagttttagcacaggagtaaaagtttatttaaaagctttagaataggaacaaaaggaaggaaagtacacttggaagagggccaagtggacgacttaaaaagcaagtgcgtggtttgaccttttgacttggggttttatacgtcagcatgctttcggggtcttgcgttatttctcccctggttcttcccttggggtgggctgtcccatgtgcctgcctgagcccactggctcaactcctgagatcttatagggaaactactgctcaccagtttcgagtgttttctatctattaggagccggcttttccctgttgccgggtgtgaccaattattactttagaaagacagtcaacaaccgccagaccatcacctgatggtcacctgacactcctggtgtgtggggtatggggagccctctcctgccctgctctttctgactagctacccactataacactcccagagggacctgcacattttgtgctctttgcaagacagtgcctgcccagcacctgtaggcctgctcaccccttcagggtcatgatttttgctttttaccgcaggtacccataagcaaaacatggcattgttcaccatgcttttacattattcacataattttaagttatttacacaacaatgtaaaaccatggtgaaccatgccacatgttgcttatgggtacctgtggtaaaaatcctgctactagctcattttgcagtgtctataatgacaggtaatgctccattcactcctttatgacacttgcaaaaactgagaacataacgcctcccagttaagcaggcatctgggcaatgtgaggagaacagaaatagaccacgctgcatttatctctcttgatgacaggcattgagatttccactttttctggtttcttattatgtctctactgggcattcttacatacatcttgcacgccatggaaagtttctctagggcagtggttcacaaactttttggatacagaatacttttatgtgcttgaaaactgaggaccccatacagctttagtttatgtgggtgtaaggttctagcccaaactgaagtccgaagggagttggtgggtgggtgaggggtagctgaaaaaacacccgaggaatcataggcagtttgaacatggccttatcctctctctgggcacgagccatatgtccagtgtcagcagggtaattataccttttacagacaatagaggctctgaagcaatcacgagctcacgtgagtggtcacctaatgcacctcaagtggcatggttcataatgtgcggagtcgtgtgcctacgctccaaacccactgagtcatggtgcaccaaaaagtggcctcagcctgctcctgactaaagcgcagccatcttccttacactccacccctaggccaggggcatcctccaggtagggacatgtgcccgtagggtggagccctgaatccataatccacagcaacaatacggagagcaacagctcatgactaggattccagctatgctacttatgactatcagggcccagcgtaggccagagcccagggatgtctaccatctctgcagggggtcatcagtaaggctcttgactaccttaatctcctgtgagaccccttgcagggctgctgttatgttctgccaattgtcagggataaaggtacaacattgtgttcctaaaagggcacaggtgcctccttaggcagcagttactatgtctaagaccattcggtttcgcaacaccacctttctgatctgatcaacctcatccattaatgggaagagggccactcaggtgtaattcagagcctgagcagcatgctctgcaagagcagtaacttggcttctacagttgtgacacacactccagggctagtgcctgtcaaggggtaaaaccaccagggtgctcattacacttgcaaaaaccgagagtgtagcacctcccagttatgcaggcatctgggcaatgtgagaacagtggcaggtacatgaggccaccctcaggtataatgtccagtccagtttgcttataggtaaggccaccctgtgtccccacagacccataaactcccagggggcacacagtccatcgaggccccttggtggggccgcgtcttccaccatacctttggtgtggtgacatgtattatgcttacacacactgtgacgggtacccatcccacagtgctattaccccagtgttgctatatgcaccacagtgcctgggccaggggtactgcacgttacctcactagccagccccacccatcataaatgctatgggccagccagggaatggctgtgctgtgggtcttgtggcatcctttgtccaaaacttgccacgttgcgttccaggcatcagccatgggaccccaagtctccagccatgtctggttctctgcagatgctgaatgtatgtgctaaggcaagccatctgcagctgctagaagggcggtgcagatccaacagttggaaacattggtcacttcagtgtaggtgtgggcccagtccacaatgcagttggagcatgttaacctacagttggaatgacagagtaggcataggtactaacagaggaaaatcacatccctcaggtaaaatacaggctaacctttcatccctggataacaatgcagcccccaaggggttctgccctgggcaatagtaccacaccttttcagctccccatggttcctttgggtcctgtattcatgcgaaagtcacaggggagcttgtagtaggccacacagacagtacatttgaaccctggaggaaagtttcttccctggccgttttcctacaaacagttaacttcggggaccattcattgaacacccaaagagtgacatacaagtcatactgtaggccctccccacagggagctacgatggacaaccaccagcagccgggggcttggaggggctatggccacagccaggttttctgttcccctgccttcagggacgttggggcaggcaacaacaggttactgttcatccccatacctggtcagaggcggttacccttggtgtgtatctgcaactgaataggggtggtggcccatgtaacaaagcctccacctgggctgggctgcttttccatggccattcattcaaggtttggagcatcaggtccagcctggaacttcagccctgcaaagacaggagtgtgacatgcaagtaaaacccattcttcaagagctcgctatatcactcaatcatacccacagcttgcaagttgtgcggtacatggaatccctactttatgtccattgttgtgcctgttgtccagtaaaatgtgtcccccatcactctcaatgaccaaagggcaaccatatagagcacataagtgttgcagggtctggatggtgtgctgttggttggccaccctgcaaggataggcaaacaacaggcctgtggctgtgtccacagctgttagcgcatgagtatacccttgtgacttcggcagcagcccaatgtagtctacttgccacctggtcaagggcacttgccctgttgtcacttgtgtagcactggacagctgcctccatttagggtatgcctgagcacatgccgggcatttctgacaagcctcccaaatgtcttgcatgggcagagacagaccccaacatttattgacttgttgcatcagtttaccccctgcatgtcccagtttccggtgtagctacaaggccacatctcatgtagatgccaactctaaccatcggaccttggccaaggcttctgcctcgtcattgctgggggtggccagaggcatatggcctgacaaatgataaatagttacatctttgcaatgacccatttcccagaggtcttgctacatgggttggtggccccaaatgggttggtggccaactagccaattctgtattttccaagtagttaaacacaaagttaggcctccatagactgcccagctatcggtacggattaccataggtgtctccgccttgttgatcaccatccatactgctttaaattcagcccattgactactttgtccacatctggtttcaaaccatatggttttggtactaagttggactgcaacactggtccaagcaggagtagcacctcgactagacccatctgtgtgccatgccccatcaggaatagagggatgcccttccttaaatggcagtggctcagggtcaaggggtgcctcaggccccatggccttctcttgcattaggactgcaggtcccaagacctcttgcaactctgctgctaatgggcttgtgctcagcgtactctgttgctccaagtaagtgcctcactttgccaaagtggatgtctgcaccatcccagtctggggggtcattacacatgaatgcacccatcccgctgtcaggtaagtcatccacactgtgactgtagcccatcctatcacttctcacaagcctgaagggcagcatatacagctgctagctatttctctatcaaggaataccagagctcagctcctttccatagttgggaccaaaagcctcctggcattctcaggcactctgtgtgctgccacaggcccaaactaaaaccatctgtggtcacatgcatatccagttcaaatgggcaccccttgtcaaatacccacagggctcgtgcctgctgaatagcccacttggctgccaggaagccagtctcagccacatcagcccaatcccagattgctcccttctttgttaactgatacaatggttttatcatttgagctaaatgaggcaggaatgtccaccaatatcccaggaggctcacaaaagtttgcagctgcctcaccgtggtgggccagggatatgcctaaattttgtcaatgatagcctcttgtatggccttcatcttacccgaccagataactcccaagaatttagcaggtaatccaggccctcggaccttggatttgttgatggcccaactgcatgctgccaaatgttgccacaagaggggtgccactgcttctaaatctgcaagagaatcagaggttaacataatatcatcaacgtaatggaacaagtggactccctttggacattttcaggctgttaaatccatggcaacaagaccatgacatatggtggagctatgcacatagccctgcagcaacactgtgaaagtccattgtcatcaaggcaaactgttcctggctctctagagcaaggtcaactgagaagaatgcattggccaagtccaccacatagtggtactgtcctaattccattgtcgagtggttcatcaaatccatgatagatggcacagcttccaagccatgtaaaatatccacctccagaatgtattcaggtatgggagagacatacacagtgtataagcaaggagccaagtggccaatgccaaggtacagagatacaggtttcactttcactgactggcctccgtaacctttaatatatgcagatttgcccaaaaacttaactgggttcccataaacaaggctacaatctatgccagtatctaccagcaccagcacccactgtacattggtgggggaccagtggattgccaattccacatgtggcctctggtcatctggtgtccccccaagccagacacctttggccagttccctagttgaacagaaaaggctctacatttccacctggctgcagcaagtagtctctgagctgggtaggaccaggtcacacagcaatgcctttctcccctttgggcattttccggaattgctgccctgcatacaactgtctccgcaaagttaggagtatttcattgggctgcttatcaattttctctcagtcaaccccagccaaaatcaaatctatccacatctgtgagcgtgtcactcgttggggccccctttttttatgggggagccccctgtgggtggggtaacttccccttctttatggtgtggaccctccaatccccctgaaggccttctgcttccctgagagccgccatggcagtggttacttcatgtatgcggtgccctacgtatggggtgaggacagcagctagggagccaaaggggctcaggagcatcaaacccaacatgagatccctcatgtgggaggtgaaacatttatcatctggccctcaggtattcaggacaaacatagcctgccgcatacccatctcccgaatgacttacaccaaattggcatatgactgccatttactcacagttttgggcatttcaccagcattattccacacagttcatatggctgcctgtagccactcagtcagggtgtggtctccttgcgctgccactaaccacctgctcacttgcagccgctgacagagagaggggtgagtcatggtggaggccagcttgtccatctcagaggtggaatgggagataccatctgctcccttgttccacagacgaagcatccaggcaggcaggggttcccctggacactggcaacactgcttgcctaattcctgcaactcagttggggtacaggcaatatacgaaatgtgttgcattatggtggggagtccctgagtccacccttggagccccagtggctgttcatgatctaccttctgtcagaccaccgggtgagcccgcaacaggggttcttcctccttggtatgaaactgagtggggatctccagacaagatgatggacccaggcctgcattcatggtagcctctaattccttttccaagctctgaagccacacctccaggcatcctgcctgcacctggaggtccccattcatggcagcctctaattattttccagatcggtgtagccagacctccagtctgcatccctcagggactgggtgtgtacttttcttagcacagttaaaaatgcccatccaactctgccagcaaaggctctctccttcttggtgctctgcacttccagctgcttcagcgccttctccatgctcatgggggacccatctactgccacccaggtttccactcaagcccaccctcacagcacggctaccaccgggtaccacaacccatgttgtggtcacatggccaacctggaatcagcagggaccgaaggctcacttaccttaggatcctgttcgtgatgccaattgtcaggttctagcccaaactaaagtccaaggggagttggtgggtgggtggcaggtaactggaaaaacactcgagtaggcggtttcgacatggctttattctctctctgggtgcaagccatatgtagtgtcagcagggtaattttaccttttacagacaatagtggctttgagccaagcacgtgctcatatgagtggtcacctaatgcacctcacatggcatggttacataatgtgtggagttgtgtgcctgcctccaaacccactgagtcatgctgcaccagaaggctgcctcggcctactcctgactaaagcacaaccatctcccttagagtgggctaaatctactgctatttatactattagaaattttaacacagaagttttaaatatttacattgttaattgattttgaaataataagcccattacaggttaacataattaacatacttttattaaaaatatctgtattttttaaaagaaaaaaaattagcaacaacagtgatccttggaatcgtcccacctcagcctcccaagtagctgagaccacaggcgcacatcaccatgcgagctaatttctatattttttggtagagatgggatcttgccatgctggccagggtggtctcgagctcctaagctcaagtgatcctcctgcctcggtctcccaaagtgctgagattacaggtgtgagccaccacttctggccagaagctggattctctgtcttgttctccatccaatctgttagactgtcaaatgccaaataacctttggaaaattctactcgtaaaataaggagagagataaataacttctgagtatcatcattaaaatagtttgacctcatggacccactgggtcccatgtggagaatagctctaagctaaagagtagaatggctgggaggggacataaacattcagcccatagctgctgaccacaataacacattttaagtctcttcctctcctgctccttgtgattgcagacagactcaatctgtaggagagctgtagagagaacaagctcaagcccctgattttgcctacaaagaaagctgagcccagcaaagttaagggacttacccaaggtcacacagccacacagcagagctggggctgagctccaggtgtcctgctacagaggccacttctttctcccactagggactggcctgtgattacttcagaaaacaatggtcagctaactgattctgaacgccctttgctggtaaaagctaatctcctgaggaaaaatgtatgcattggctgggcgcagtggctcaagcctataattccagcattttgggaggtggagacaggtggatcacttgaggtcaggagtttaagaccagcctggcagtcatggtgaaaccccgtctctactaaaactacaaatattaagctcggcatggtggcaggcacctgtaatcccagctactggagagactgaggcaggagaatcgcttgaacccaggaggcggaggttgcagtgagccgaggtcgcaccactgcattccatcctgggcaacagagtgagattctgtctcaaaaaataataatagtaaaataaaaataaataaacaaataagtatgcatcacctcaggtggtcagtcagctttcccaagaccccaaagcacacaatgttctttctggtatgagtgacatggggttcacagcaccacaaagtccatgacttttccctcagaagtgaatgcatggctaattattttgtattttttgtagacatggagttttgccatgttgcccacgctgctctcaaattcctggactcaagtaatccacccacctcagcttcccaaggtgctgggattacaggcatgagacaccgcatggcctgcacctatagtcccagctatcaggaggctgaggtgggaggatcacctgaaccggggaagttgaacctgcagtgaactgtgatcgctccggtgcactccatcctgggcaacagagtgagatcctgcctcaaaaaaaaaaaaaaagtgaacacacatgctggggaagaggcctgcaggcacccctgccagttctgcaccagagcacactgtagcagccctgctgtgatgcaggaagcagctccaggtcctgcagtctgaagcatggagcctgaagcctggagccccccatccaatgctgcgccatgctcaccagtatcccccagcatcagcaccgaggcaccagctgcagataaatttctcacctaaaatgttgagagatgttgctaaactgtccttctaagggtatgtataataatacggtcctgccgatactgaataagactatctgtttcattacatcctcacaatactgaatatcattagcaacttgaattttaaattgtgctaatcaatgaaaatgattgcctaattactagtgagttgaggttatttaacattaatactccttctgatgaaatattttgcatttatcacattttacataaattctctctatataattagcactagaatgtccgacttggttttcattgttcctcacctgtttggaaacacattaagaatgagggagagaatggatggggactcacctagggatgcatggagctggtcggcagccactctgaggccctcttaacacttccccaccacacacttaatttcccctggtttgtccatagatacatccaacaatttttatgtaaataagaaagactcagctttcaatggaaaatggtaggttggattttatgactgaagtggcaaaaagaaataagggattttattatgggggaggtccaaaccctggtgaaaaacgaaattcattgaaattgtttgaaaattcaaggattaaatcagattattttggattcagtaggaattagattactttaaagccccaggatactttattctgtagaatgcatggaaagtatagaaaagagaaacaaagagggaaagtcatggctaataacctggaaggggtaaatagggagccaaaggcctgtgggacgtaaccaactcagcattccactggaggctttatgatcaaatagcaagctatttatcatgaatgcaggatgtgggcaaactcacgactgctcccactgccagaaggtttgctgagggcaatcacttcctggcaccgagctccttgaggttatctactgggacatctggagaatgcagtcttgcaagcctactctggacccagcagctgaccccttcttccatgcccctcttcctgctatctcttttgcctaataaatatggagggctgtgtaaagctcagggcccttgtccactagaggcaaactgcccgctgaccccttcttccaaatatgctcttttgtctcatgtcttttattcccgctttcaccccactttgttcagtccccctagggccgtgtgggttacatagtggcgccctgaacagcgacagaatcaggtgctctacaagtggcgtccgaacacagggactatgaggatgtgaatgaagaagatctgctggagcagaggaattgaaattgacaaggtgaatggggatcccgggacaagtctgccggcagcagatataaggtcagtgccctaaagaggtactgggagcagtgccttaaagtagtactgggaatgggaagttttctgaatcagggtaacatggggcagaattggtctgttgaagaaaaacattatgtgcagttgcttaaagttttgttgaaacaaactggtgctcaggttagttctcacattaactacgatgctacaggaagtcattatgcataacccatggtttccacaggcagggactcttgatgtagaaaattgggatagagcagaaggattaaaacaggctcatcaaaaaggttttcaagttgattcttcagttttctccacttggagtttagttcgtactgtacttctgccattatctccttgttattctgcgggacagcaggctgaatgtaaaaatctgaaagaatctgttgtcccacccacagctccagttgaaaataagtaataggagagggaggataaaaattggcctataccgccccctccagttgcagaaacatctgtaccgcctccttcggtggcagaaacagagaccccaatacaaagaattttacgctctgccgccacggctggagagcccttaggaccttgcacttttcctatttccgtaagtcctgatccaaataatccacagcagcttaatcatgaacacattccactagagtttaagttgttaaaggaattaaaagtgagtgtggtaaataatggcatacagagcccattcactttaggattgctagaatctatgtttggtgctatgtgtcttttaccctttgatgtgaaacacttggcatgaacttgcttgtctgctagcgcatatctgacatggaatttaaactggcaagaacagggtgcagaccaggctagacagaaccatgctgctggaaatggagacattacagaggataggctattgggtaatggcccttattctgacctggtacatcaactagcactcacaaatgctgcttatcagcagtgcacacaggctgctaaatgtgcctgggccataattcctgaagagggagtcccagtactatcatttttacatatcatgcaagggtcacaggaaccctacgcacaatttcttgcaagattacaagaggcagtgaggcatcagattcctcataccttggctgcagaaatgctaacctttactctagcttttgagaatgcaaatgcagattgtaaatgtgcactggcaccggttaggtgtacaaaaacttgggaaattttctcagagcttgttaagatgtagcaactgagctttatcgatctgcaatgttagctgaagcaatggctaatttagctgttgacaaatctaaaaagagccaagggtcaaaccctaaaatgggaaaatgttataattgtggaaaaactggacattttaaaaaggaacgccaccagatctcaggacagaaaggatcttacaatgcttttccccccggcccccagcggaaagaacacctggactttgtcctcgctatgacaaaggaaataactcggctaatcagtgctgctcaaaatttcatcagaatggcacccccctgttgggaaatgagatgggggcctgtacccgggcctcacaaacaatgagggcattcccaattcagacctcaaccctgtttcaggcatgggttcccagaggcatattgagtccctcacccgaggaactccaggaagtgcaggattagatctcccagccagagaaagggttacataaggtggggaagacaaacccaccaagattctcactggcatttggggacctttaccagcaggatatatgggactaattttaggcaaaagccaccttaacttgcaaaggcattactgtagtcccagaagttgttgactctgattatgaaggagaaattcaagtagttttattgtcacgagatcttcgggtttttgaaccgagagaatacataatgcaattattacttattccctgcaaattacacccttctccatgaaaggagaaacaaggaaataaagggtttgggagcacagctacacgggaaatctatctatcccgacccatagcctctaatagacccacctgtgtagtacaaattaaaggaaagaaattttatgggtttatggataccggagctgatgtgtcagtgttaccagcaggtctttgttcttagagctcccaagatggcggcaagccttttgttctctgacctggagttcttggcctcacagattccaaggaatggatccttgggccatgcagtgagtgtcatagctctattagaagctcttccaaaagtcgtgctgctatctatggactaaaacatactcaaacaataatgacctctggcgtttaggctcaatgctcagagctaattgcagtcattcaggttttacagctcacagcttcagatcctgtcaacattgtctgtgttcagtttatgtcgtaaatgtagccggtcacatagaaactgctacaattaaaagtacgctaaacccagaactgctaatttatttttaagacttcaacaagttatttgttctagtgcagctccttttcatatttctcatattccttctcacacacaacttcctgggccgctatctctaagtaatgagaaaacagacaaactgattgcctctgtgtttcagcaagctcaaccatctcatgtgcttctgcaccaaaatacttccgcccttactcacatgttcctacaggtttgtattatattatgcagtatatccctcgagccacacctatagaaggatgtaatccacgaggtttggctccaaatgaaatctggcaaatggatgttacacacacagcaacctttgataagctgagctatgttcatgtgactatagacacttattctcatatgctgcctgctacatgccaaacaggtgagacagctggtcatgtacagcgacactgtctgtcatcatttgctcatatggggatatctaaacaattaaaaactgacaatggacccgcttatactagtcatgcttttaaaaatttcttgcagctttgggctataacccataaaacaggaattccttataatcctagaggacaaggcattatagagcaggcacatcaaacattacaatgcatgttgaaaagacaaaaagcgggtataggaggccaactaccacctcaataaaaactacatttagccttatttactttaaattttttgactcctggtatggatggtaagactccagcagaaagacattggcaagtgttagaagaaaagaggaaaatttatccaaaagtgttatggaaatccctggaagaaggaaaatggaaaggtctggtggatttactgacgtggggaagagagtatgcttgtgtttttacaggagatggacaagccgtgtgggtgccctcaaggtgtgtgcaaccatggaacgggagactagaggaacccagggtggccaaccatggacagggtccccccggtacgagccatgagccagctgagcctgagtgcaaagacggagagaaggccaactggagtcacaacacagttctaatgttatatttgtaaagaatatcactactcaacttacagtttgtgtttatagatatagatatagatatagatatagatatggatatagatatagatatagttatagatatagatagatatacactttaagttctagggtacatgtgcacaacttgcaggtttgttacataggtatacatgtgccatgttggtttgctgcacccatcaactcatcatttacattaggtatttctcctaatgctctccctcccccagcaccgcctcccaacaggccctggtatgtgatgttccctgccctgtgtccaagtgttctcattgttcaatttccacctatgaatgagaacatgcagtgttttattttctgttcctgtattagtttgctgagaatgatggtttccagcttcatccatgtccctgcaaaggacatgaactcatccttttttatggctgcatagtattccatggtgtatccttatgtctttttgacagctaagaaggaccagctccaggtaaacaatacccaattgacctgtaaatcttaccaattatatcactgcattaatcatagcacattgcaaacacataatatctctactttgatgattttaggccacatccctgggctatgtattcctgttaatctgtccgaggcttgggctgccacacctgctttgcattttgtgaaacttcttctaactgagcttactcatcatgtctgtagagccttagacataataattttagctattgtttccttggtcgcactaataacttctgttgtgatgtcctctgtagctttgcataattctattcaaacagctcagtacatggagaactggacacacacagccgaccaagcatggctacttcagaataaaattaacactgagttacaaactgaagtggtgttatgggaagtcagggaccccaaagagagggaccagctggagccacagcagaggaacgtaaattgtgaagatttcatcttaatacggatatttatcagttctcaaataatacttttacaatttcttatgcctgtctttaatctcttaatcctgttaccttcgtaagctgaggatgtgcatcacctcaggaccactgttataattgtgttaactgtacaaattgattgtaaaacgtgtgtttgaacaatatgaaatcagtgcaccttgaaaaagaacagaataacggtgatttttatggaacaagggaagacaaccataaggtctgactgcctgcagggtcgggcaaaaagagccatatttttctttttgcagagagcctataaatgaatgtgcaagtaggaaacatatcgctaaattcttttcctagcaaggaatattaatattaataccctcggaaaagaatgcattcctgaggggaggtctataaatggccgctctgggaatgtctgtcttgtgcagttgagataaggactgagatacgccctggtctcctgcagaaccctcaggcttactagagtggggaaaaactctgctgtagtaaatttttggtcagaccagttttctgctctcaaaccctgttttctgttaagatgtttatcaagacaatacgtgcaccactgaacatagacccttatcaggagtttatgatttttctcctgtcctgtttcctcaggagcatgtgatctttgttctcctttttgccctttgaagcatgtgatctttgtgacctactccctgttcttacaccccctccccttttgaaatccttaataaaaacctgctggttttgcggctcaggtgggcatcacggtcctaccaatatgtgatgtcacccctggaggcccagctgtaaaattcttctctttgtactctttctctttatttctcagccagccgacacttatggaaaatagaacgaacctacgtgaaatattgggggtgggttcccccgatatgtgatgtcacccctggtggcccagctgtaaaattcctctctttgtactgtctctctttatttctcagctggccaacacttatggaaaatagaaggaacctatgttgaaatactgagggtgggttctcccaataaagtggtaatgttgaaatccacagttctatggttaggggaaaagcacaaagcttgcaattgcagcagcaattgcattgtcattttaatcacactcatatttgtgtaaccaacttagaatataaccaaagtgagtatctgtgggacgttgtgaaagcccatttgcagggagctttcacatctaacatcacctttgatattggtgaattacaaaacaaaattcttgatttacataggcaaattcaagagtttctgccttctttagaagactggaccaaattccagcaaggcctggagagcctcaatccttggacttatctaaggcactacattaacatcttacatgtagttcttggaataatattgttttgtctctgtcttctgttcatagcctgtaaaattggatggaccaccaatcggaaaatgagagctgcccaccctggccttacattctttcaattaattcataaacagaaagggggatatttagggagcctaaggctcgtgggactgaccaactcatcattccactggaggctatatgataaaacagcaaactgtttatcatgaatgcaggatgtgggcaaactcacgactgctcccactgccagaaggtttgctgagggcaatcacttcctggcaccaggctccttgaggttatctactgggacatctggagaatgcagtcttgcaagcctactgtggactgagcagctgatcccttcttccacgccccccttctcactatctcttttgtctaatcactacggagggttgtgtaaagctcagggcccttgtccactagaggcaaagtgccccctgaccgcttcttccaaatatactcttttgtctcttgtcttttattcccacgtttgccccctttgttcagtttccctaggtccatgtgggttacatagtggcaacctgaacaatgacagaatcaggtgctctacagaaataactttttaaggaaagatttgggacttagagaccccaggagacatacacaaaaatgataagaggatgtgcccaaaccagtcttaaagttgtggcacagggtgaggaagatgaagctgttactgaacctcagagagtgactggtgttacagcaaaagttagcaatggcctgaagggagggtttctgaaatcaaatatgaatgattccccctcagggaacccaaccttgggaactactgcatggttctctgtatgggaaaatatcattaatgcaggataaattgtgaaatatcacaggaagcatcctgcatctagtcaatcttctgtttctggggtggcctgtgcagctgtgcaggcagaggcccaaccatcctggtgagtggcacacagggactgagatccagccacacctaccaggccatgctctgggaagggggtgggacctgggcaaaggacacctctctaggactgcacagaagcctttgtgggtgggtgggacattcctgtgatggccttctggctgggcactatgaaatgctctgaagatttttccttgcactgttgcactaaccccagtcctctatcactgccccttcctcctgggcgacttcactgatgttgtggccatgtgaattctctggccaatgaaatgataaagatgatatggcctctgccaagcagacactgtaagtattattgtatgatgcttttgtctctttttttaaagttaaagcagtttattaagaaaataaaggaataaaagaatagcactccataggcagagcagctgcctctgtctcttatattttcccctctgcctcaagcccaacatgcccaaaattggggctgctggttcagcctgggtctcagaataaagacatgagccacagatccattgctgacccatgatggagatggacacaagagagaaacacatttttgtcatgttagccactaagattttgatttggaggccatttgctacagcaatataacctagcgtgaacagagagacacagcgatgttccatttcttttcaacctggaacaggagaatttcataggtgggcctcaatttcactttagtatcttatttagacaagaaagttcatactgttcaaatgtcatgtttaagagtgctggcattatcactgctgtggctaccccatcagatgttgctcactgactaatcttctcatgttagtgaggatggacaacatatcaggccataattcaaagtagcaaataggaaaagagcttcatcctagcattatgggaccttaattaatgtcctttcctgacaggtttcagaggcttttgcaggcagcagcagagctattcatctcactgacagtggggaacatggccaaatggttgcccccacaatggaggcagagtttcaggacacttgtctgatctctgcccttgaaggaacagtctcaccctgattgacacttttgcctgttatgtccaaagaaccaatggaaaagcaggaaaattattccttcttcatttctctcttcattatttaaaattattctgtcttcacttctctctccttttctctgcttcctacttagctctttagaaatgcaattataatcttttatctccccttcaccagacactcccaacagggcaagttcatctaactatgtgctcttagttagacgctacagagcagaactctctcccaccaagagactaccttgagacataacagtcaattcacaagccaaaatatgcccgctatgaaactctcccatctggaaattttttggctgcttttacaacctagttttgcccacaaaggcaccagcagtaaccaactcaactgcctggtagacaaggcaccaaagccagtacccagaccctctacctgctcacttcctgccttgcatgccacgccccccatttaaaagcctctgctttctgctccaaaggtgaagcagttacccttaaggaaagaagcctgtacttcttcccctaaggtagctttggaataaaagtcactttataccaaacctagctcttgttaattagactctgcaagtgatgagcaactgaacctacatttcagttataattcctatgcttgttcttcctgccctgccttggggacacgcacacactcccaggcacatacatgcacgtgcactgagacagctatgtgaataaccaacaagatccccttaggaaaaccggtgcttggcctggccttaaattccagacccttgggcatcatacccaagactgcaagaaagaggaggggctggacctgaaaaacttggaagggaaggtccaactgtacaggtattttgtcaggcatgtgatttcagtataaaattctagaaaagatgagtgacactttataaggagagaatatcaacaaaatttctcattttacttcttgctaagacgacagcagggaattgtaagcagatggatgggcaatccccaccttcagcaggggaggccaaggccccaacacacctggggagaagagctgggggcagtgaatggctgaggctttcttggggagctgggccatcttcttcggttttacttcctgaggaattcacaggcttccaggagggctgtgggacacaacagagcaagagattcagaaactgatttcttccattaaaccagttatttaatccaataaatcaaagagaatactaagagttttctctgcccttctcccatcactgagtcagtgcttgccacactcatattcccactcccctactcctagcgactacggtgttcaagggagccagagtctagccctcaccagccagggtgtttccctgctctggcctgagagacacaaccaccctgcacttgtctctgattgaatcgactgtcacattctcaagttcacaagacattggtggtcctctagcttctcccggaatgtgaacctgtttgcaatcatgttcacctgcagattcactcattcattcacagatccttactgagcacctgctttgtgtgagttgctgtgctaagtgctggggacacagcatggatagactggcctgccctcaagaagcatgtggtctatgcagtcctgagctggctgctcacaagaagagccctgtagccatatttctcagagggtggtcctgacctgcatcacagtgacctgagttgtttgtcaatacagaaaagggtttctcaaccttggcactattgacatttggggcctgataataaccctttattgcagggggctggctgtgctttgtttagtagcatccctggcctctacctatttgttaccagcagcaccctctatgttgtaagaatcaaaaaaatgcttctcacattgtcaaatatcccctcaggggaaaaattgtctctcattgaaaactaccgataaagacatttctggccctgcccccatccttggaccaacagcatccctaatgcccccaactctgggtgagggaccaggaataggaatctgaatgattgcagtgcacagggagctgtgcacactgaaatcccacagttatcaccgggagccttacaatactctgtgatgtcttctaaatatttttaagggattaaattaatatcaacatatttccctggttaagatgtgttttcctacacttgaatttttttgagattttgttttctctatagttggcatctatggtaactgtctagaatcagatttttttttttttttttttgaggaagggtctttcggtgtcacctaggctgtagtgcagtggtacaatcatagctcactgcagcttcaaccttctgggatcaagcaatcctcctatttcagcctctcaagtagctgggactagaggtgcttgacaccacaccaggctaatttttaaaattatttttgtagaacaaggtctctctgtgttggccacattggtctcaaactcccgggctcaagccatcctcccacctctgcttcccaaggtggtgggatgacaggtgtgagccatcacacctggctggttttgtcatttctcaatgcatatgtatatatgcacctttcattttactgaataaaatggattatcagtttccaaagatttcatgacagtgccgtcactatccgtactataaaatttataaaaatttattacatactgctctattttattctctaattattttatcaatgagattataatttcctgaactgtaaagagatattatctttccttaacatttttacacctgtgttcgttcctagaatgctgtttggccctcaaaccttgaccttcacccatggtggtttctcggggatgctagctagggtctacttacgggaggttgagcactttttcagattagtaatgcctgcgacatactgtggtcccaaatatttttcatatgttgttttgccatggagtctggccagacactcagtgttgtcattgaacagaaggtttttggtttcagactggaataagcaaaacttgtccgggcagtcagatccatttctcccaaatttagcctgcgacaaaagggcagacagtgagtagctaaggaaaagaggaatttgtgggttaaaggaggcaaaggggtatttcttccacccaagaacagccctgagaaaaccatggggcagaaggagctgagttctggagtcattccacctccttagtggagtcccccaccccacactcctggtggcaggcccgccttgggcagcatccaggcctcacaccacttctggtcctacctcctaccatctgccatctttccttccttcttaacctgtgaccttttcccatacaacttcttatgggtgacaaggcaacaatggaggggttttgagatctgccctcacaagtcaattgctcaggacattctaatatgcagctcttctagagaggcaggctgctaggaaaacccaggctcagccactaaccagctcagtgtgcaggtcggtcaccctgcctccctcacacagttcctgctctgtcccaggctcccatgtggggagactgagacccaaacccctcagtcacggcagctctctcaccagcaccactgtgtgtgcacattaagagctccataaaggccagttatggtggccagtcttgttattcctgagttgttttcttcaaaagcacacagagacatgatgttatatgataaaaatagaagttctaataaaatcccagattttaagaaaattttgggatttcgttcaaatcacatttagagagccctaaatctatagggcaccttctgagtttgctgttttagaggcctggtctagagcactgttcactcggcccaggttcaggaaatgtcacctgagtaaaaagcactatactaatgcatgtgggaggaaggctcagtggcttcctcatttgccagaagaacagcaggagggaaaaagacagcctctgagccaggcagtgatggcaacaaggccagggcacagagtctcagcagaaatggagtgagtcccagaaagcccagagtcaaaagcctctgttgttcttgttgacactctgggcaacgccacagcatgaagccaatactctcaccatgagcttcaagtagaggactagagaggatcgagtgggctggtgcacctagctctgtgatctcctcacctaacatgagcccacacagctaagaaagcactagaagccctgtggtccatacctgttggtggagcaacacctgtttcaggcgttccaccttatccatccgagacaccacggcatgattcggggccatggcaagatggcagcttctagcctcagtcacaggcttccgtttgccatcgaggcacagcagcgcaaagtctgccagcttcaaatccttagcccatgcgtcattgttatttcctggggagaaaaagaaggtggcatcatccacgcctcccctgcttagccaagaagtctcttctgggtgggtgtggccattccactgacctcccaaatgcacacactggggttgtggtgatgtgaggaacagagaaggagcttcatcctacacaagctgtacaaacttcaaatataccaaatattagtgctgtgtccatgcaatggaatgttattcagcaataaaagggagtgaagttctggtacatcctgcaatatgcatgaacctcgaaaacgatgctaagtgaaagaagccagtcacaaaagaccacacaataggctgggcacggtggctcatgcctgtaatcccagccctttggaggccaaggtgggagaatcacttgaagctaggagttcatgaccagcttgggcaacatagcaagacctcatctcaaaaaaaaaaacccaccacatattatatgactccatttatatgaaatgtccagaataggccagcctatggagacagaaagtggattgatggttgccaatgctgaagaaggatagggcaatgactgataataggtgcaagggtttctttatgggaggatacaagcgttctagagttggattgtgttgatggctgcacaactctgtgaatgtgctggagatcactgaattgtacactttgcatgggtggattttttagtatatgaattctacctcaataaagctgtttagagttcttatttttttaaagaagaaaaccctccacctatgccatatttttcagtgagttccagaaaaagaatagatggtttacattcaaggagaaattggtttctcctccctttcatattcaaatgctattagtgtaaccagagaaaggaaaggaacttttataggtttatcaaatatatacagccaattctaacaaaatacagttgtaaagtaccggagaaagttaaaattaaatttgacatcaatctgatccctggagattacttcagttaatggcttgtaaattctaaatgtaattgtatgcatgtctatgtttgtgcagatgccggctcattgttccggctcccgtttgtctctctgctctctccctttaagaaagcactttattcattctcttggattcctctatttgatattgaaataatttcaaatttacatgtcttgttttaatctctgtcccaagagacactagaaggagcagaagcagaagggagaagtggctgagactgcagtgattactgaaggagggaggccgaaagtggagacagttctttctcaggaaacagaatagcaagtcacctgctgagacttgggggttggaatgctgaagtggggctaaggagacagatgcagattggaaggtagcaaatggctgaggaccaggagagagagtgattgttcaaacattggctggaagattatcttccatcatctgcaaccacctgtaattttgttcccactaactcccaaggagtctccagaccaaggctcacatggggatgaatgaaggcctctacttcctttttcataaagggaggcttcatttgcatatgttcacccagtttgtagcatcatccacagtttccaataggcatgcatgatctcatgtgggcagacagtgtgtttctgtggttgactagaggaagccagggagacatttgctactgagcatggctagtatctgtgtgtgtgagagtgagtgtgtgtgtgtgtgtgtgagagaaagagagagagtgtgtgtgtatgaatttcgtttcaaaatccatatgacacctacagatgttatcatgttgtctattgagataaagaattttggagttcttttaatcacaaatatggaaaatgttataaaaccttcccaaaggcaaatctgaacactaagatgtgttgtgatgccaaagactctgctttgaaggagaaaaggaaacaccttcacctaccatcagtgttctgcaagacagtgacatctttcacaaatgcaacgtctccagcattctcagccaggcacctaaaatgttccagaaaatatacacataattacagaagagaaactagtggggctttcataaatatttgtaatatgcattccaaaaactgaaatatggaagtaaacatctaaaagacaactatttctaggaatttactgtttacagcggcagattgaacacaggtgtacctgccctccttttaaaaccctatataaaagacattacaaaaccaagaaatctaaagatatgcgacccaggaaacaggcaatctaacatgaagtaagacaaaggaaagcaccaaaataatggtcaacaggacccccaggaccacagatgtgcaggcggcctacacagcaaccagtccaaactgcagcaggaagatggatgccttctggagcagcacttccaagtaaatgatgaaactgtgatagcacccagagagagagagagagagagagagagagagagtgtgtgtgtgtgtgtgtgtgtgtgtgtgtgtgtgtgtgtgtgtgtgtgtatgcatgttgttaggagatttacattactggcagacagtttggggatgagatagtgatgtgtttttttaagtgcagaaaattaagcaaataagaaaagacatttatgaactccagagtaaacaaaaagtttgtacaataagggaaatataatatgagaataacgcttacacagtcataagtactgaatatgacattagcgtgttgggtgctgaagagagttgaagtctgtggttgtgtggtggaaaaggtgctgggggcagtgtgagaggctagatcttcttctatactacagagtcagcagaaagttaaaaattaagaaccagcattataaggatgatagaaataaaggggtatgacactggtttcagcttttaatgattttgctataaatttccccaatctagattctagatataatttaaacaaaagacaagggattttcttccagtataattaggaatattaaaatgtgggtgtttccagtgaactaataccttgctgcaggtctgaaaaaaaaaaaaagaggagcacatgcttctttcgggctcttatgagacatgtgttcagcatttctgagtagaatcacatttccatttgcaaatccttagtcccttaaagatatttttatacattcacaaaacatttttttttgttttgggtctttttttatgagccacttatatagcaaaagctacttttctgtcattccattactggaacaaggctgttgaatttatattaaaaagttcagacaccctcagacacatgacgccatctggtcgtgaaatgtactcttggcaaatggaggaaaaggaacaggggaagatcctctctgcacccttcacactggtaaatagtgcccctgagaagcaacacccggatgaatggtgctgtaaaacgtggggtgtggttacaagtcactaagtggttataacttatgaattctgaaaacttgttttttggcttatttttcacttcgttactggagaataacactgcaattctgccatctctttgccatttctaaggccaaagtcagagaaaaagggaaacctaagccatagtcatgacctaggtgagaagaaaaggggcggcgatgggaaagagaattcttccccataaatggaattgtaggaagcacttaggataccacactctacccatttgattttcaggacgaggctattgaggcctactgctgttgatcttggctcaaagccacagggagaagcactgcggagctgaggtcagacagccctggtgccagcctccactctctggggcggtgggtgtggtggggacagccctcactggggccacccatgagctgacccacaggatgacccccactctgctgtgacaggtcacatctggctccttagaactgcaatgctgacatgctgagggatgaggtaagtccccatcctgatggagctcagtcacagactcaccggaaagccccagtgtagccgtagtatctctcgttgctgttgggcacgcacttattctcaccctgctcgtcgccaatacacagagcacagagattagatctcgggtcagacccaggggcacagctttgactgaaatattcatctggagagaaggaacacggggagtcagctcttcaaacctgagtccacacaagcaacctttacctaacagccgatgcagggtggtttcagttcattagacttcccaggacagcaatctagatagaacacactcaccatcacaaagcaacatgttgtcaccaacataggacccaccagaaaagcttcattcagactgtaggcacagatggacacccaactaaggctggggatgagagctgtggctgcctggagggtcccgtcatcacagccttgagctggggactcagctcatgaccgtgatggctgtgtgcagcagagcctgtgagttgcctagtccaggatctgattttgtttttatcagtaatggaaaccctgctttgtatctgggtgcttggccctttggtataaagactagacttatcagactccctggggctcatatggccatatgggtagctataggccagtgaaatatcagcaggagtgttgggcgccagcttctcagaaacatccttgaaagacaattggtacatgccttttgccctttcttctccttctctttcttcatcctgcacatagaatgcagaagcagggactggacttagagatgcaatgtgggccatgaggtgaccttgagcatgaaagccacacaaatggcagagtagccaaatgattaaagcccaggttccagaccccatattgtcttcataccagccctaggcaaaccacctctggactacatgacacagaaattaacttctgtcttgtttaagcctctactatttcaggagttttctgttccttgcagctgaacctgatctgaattcgttcattgtgtgatttaacccaagaaagaataaacaaaggtgacaagaaagctctgccccactgagcaaacgtcacccattatcagactcccactgctgctggaagagccacactatgtgtcaacctcaggaaaagctgggagttcccattccatcctggcagtttccctacagctcagaggctgccatggagctggtgaggagcagagccacgtgaaagctgcctgccccggccaggatcaaaaacccatgcagtggagcccctgccctaggagacgcccatacaagaagggagtcacattgaggatgtgctacacaccatgccacggggcccacagcaggcagggtgtggctgatgctgactaggatgagtgtggggtgtggtggggagagaaaactgcagaagcaggtggagccaggctcttgaggtcttattcaggctccgttgcagtgtagagtaagcgtcagttttgcttagtaacaggagtcacctttcatgaggcaggcagacatctttccccaagctgggaagccagagtttaagaggaatttaggtctggagctccaagaggtaaaaagcatttgcacatcttggaacttgcatttattcttagggtgcagcgaaataggcagatattccaatctttaatcttggggtggggtgaatggggcatgggaagtgctgtgcagggaaacccccagtgcacccacgcctccagggggcagccacagggagaatttccttatgctggaagaggcctgcaggccactatcagcctgcaaatcccctcccctcccttccctaaggttccacagcacaatatgcctaccctccagggtggcccacccaccgcacctttggaactccttaccaaatttgcaggagcccgtctggttgaagagcaggcccatggggatattccagcctgcagtcctgtccacggcggtgtggcaggacttcttgcctttcacagagttccaggtaaggctagtgtctgatctcctaaccaccgccacagcaagatatcctggcataacagatgacagaaaaacaagtcttaacctccaggaggcctggcacatggattccagtggagctgtctacagcccaggccaaaacaggccaagaagcaacaccaggcaatgattccctcaaagaactggcctttttaggtagaccgagaaagcataagctgctgccttatgttaaggtgagattgatgaaataaaacagtaagaaaagctgattattttagtgattacaggggactgtcttcaaccagccacacaatgtccctgagttacaaaccagcaatgcatctctcagtgtaagcttctacagcaacaaacactataaacaacaagagagaccccaacagtgcataaatcaccaaccacagtgtgcatcaggcaagagcaccaacatccagccagctaacggctgtgtgggtacaggggcacatgtccccagggactgccctgagctgagtctgaacccaccctgcactggttgaactcaacatggttgccgttgtcctcctgagagaatgcatctgacagacacccaccaagggcaagtcttttctgaaactgagcaagcaccagctctggtgggcaggaggagtggtgcacagagcactgggacacgagtcccaggtcacgaggacccggggtcaagaccaggatctaccacagtattacctatggctgtgagtgagatcctgggcacttggggactctcggtgccactgtttcctcatccccatgaggtggggaagtagcaccccccattccatgaccatgacaaaatgagggactatatggatgttctttgccaagtgtgaaggtcaatataaacattaattagaactattcctctgtgaattatttgcacccttaaaattattgctcctagaagccctatagcttctagggctgcaattctttctgttttttttacagttcctgccacttcctcttccagcaacaagaacttatccttgaccctgaaagtggctaatgccaactcaccttccacaggtctatccacacagttaggatcagggtcactgctttgttgggattctgaaagaataaagacaagccagacatcattatccattcagatgtagtgagaagccacaaactcttaaatctcaatgatgcagaatcaaatccaaagagaccgtcccagcagttccatgcaggagaaatgcgtctatatgttcaacaaaagacatggcacagagattcacagctgcattattcaccacagccaccaactggaaactactcaaatgcccatccacactcaaatgatgaataatcacagtagactcacacagcgacgagactgaacagtctacaactacacacttaggtggatgaaaagcataacgatgagcaagagaaaccagacataaaaaaacacatgctgtgtaattcctttaacatgaagtttaaaacataggcaaacttagatctgcgaccttagaagccaggagagaggcttcccttgcaggagtaagggggcgggggacaggaggacataaggggcttctgaaacttgcagtgtttgttctgggcccgagagcatggactgtacagtgtgtgaagtgccatgagttgtacatttatgtgcacttttctgtttgtatgttataattcactgagatcttctggaaaattaagaagataaaaccaacctgtcccttgttaattctcaacacaataggctttgtgggtaacacggcccctttcatttcttctttccctgattctcccttttgaatgtatctgttcatcataatgtttcacctgcattcaccgaatgggattactcatagccccactcccatgacccagagggaatataccagaggatgctaactccacttactgtagttctctgccaggacaggcaccaaaccacatttgcctgcagtgtacacatatcctccatccaaactcatggcatcagcttctcctttctgcaaagacagagcagatctccagcaccacagtgaggctgcatcccgtcctgcctgtctatatagctctctgagagaatggttttctgtcaggtgaccagtgaaacagcagaaagagatggactattcaaactgagcagccagaggaaacaccgtgtgcaccactaattctctcccagccctgcctactttctgggctgtcaattcaactggaaagaccaggcacaggttgcactaatcctctgtcctctgagcaaaaccttttctgtgtccctggcactttggggacaccttcctggagcagtctcactgactgaggacacagatgggaacagctggcctcatctaatctgaactcattagcactccactccaagcgctacacagaagttgtccaacacataagctgaagtcgtcatattggcccaccaccagaatgaacaagtccaggctacaacacaggatcatggactcatcagtagtatgaaacttcctctttgacccagtaatatttttacaactatattaaaaatagagaagtggacaaagatttctactcaagaatgctcaccacagggttattgataatagcaaagtaagggacaaagaggaatgggggcatgactaaactgagccatattcacataaaagatatcctggaagcatgtttaaaaaatgttttcgtccgagtgctgtggctcacacccgtaatcccagcactttgggaggccgaagcaggaagattgcttgagcccaggagttcgagacgagcctgggcaacaaagcgagaccctgtcgctacaataataataataataattatgcaggtgtggtggcgtatgcctgtagccccagctacttgggaagctgagatgggaggatcacttgagcccaagagttccaggctgcagtgagatgtggtcgcaccactgcactccagcctgggtgacagatcaagaatctgtctcttaaaaaaaaaaaaattaatgctttccaagagtaaatattcatgtggaagaatgcccattatacgctgtttagtgaaaagggcttaaaaacgacatactgcaacacttcattattgttgcatgcatatctgcagatgtgcagagaaatactggaatggagaattagccagactttaaccatgtctgtccctctgtgtgagatcacaggtggtttggggggtttgttgttgttttgttttaacataatacctttccatattttccaaattccttataataatcctgagttgttcttataaccagaggagtgggaaacccacagtaaactgctttttgaaactaaaatgctttctggccctgagcacacctctccaggcatccctgcctcacccaggcccccgtggcctctttgactgttgacttcactttaagcagatgcccaggccctaggtcttccaccgggcccaccgcccgcccctgtgatggagctccctaccagcaccagggcgatgcagtcctctgtggtggaggccgaggagcaggtcacgctgccttcgctcaagccactccactggttacacttgcgcagctcctgctcgcccaccgcacaccacacgacccgcgcacgccgggcagccacttcctcctcacctgccagagggaagaccgcaggtggctgggcaacctgagctttgccaggttgtccaacctccccagagccagggtcctgcccagactctccctggaacaggagctacagtacatgtgtggacatgtggacccataccctctcctcctccacttctcagctccaagccccttcttcaggtccacagagctccctgtgtttcccacttctgttcctttggagaagttccctggcttctaatctatccattaatctttagagtcaggaggcgcctattgtctctgtctctgaggataaacgctccatgacccagagaccagtgacagtcccaagagatggcctaggggaccttgagcccaaccctgacttcccctaacgcctgcaatcaccaccaataactacggtgcagcctctgggttcccccagactcccacccccagccccccagtagagaaggagccatagctgagttcccccaccatggtgtccccaactaagttcaaggtctgggcctgggaagtgtgggtaaatccaggcccccggattcatccaggaggggtcctggctatctttgttcatgttcatgtttctcacttaataggaggcaaactgatttttctgccaggcctggggagcctgacgtgcactgatcaggtggccagactattcttttagagacacctgacctaatccacagaagacactcacacctgcatcaaacctccacgatgaccccacagtgtctgggaaaaggagtgaccgccacaaagtagggccacctgctgggaagtagaagaccacaccaggcggacctcaggaccctcctgggctcactcacttttcctcaagttctggatggcagtgaagtagccggagccaaggtacagcccagaatctatcctcgggggcaccctcgaaaacccaatggcagagtccttgaacagcagatctttctgcccactaggggagccaaagagctggaatttcggtgacttgtcctttccaaacttttcctaattaagaaaaaatagaattatggtgtcaatggtaaatagggaggaaacaaaaaaatgatgttaaaaaagagtatctggagctttgggatcattctaactgagagcaggagcctcggttgagaccctcctgcagagggacttgtgccatctcggagacccaagctcagctatggctcattctttgaagagttgctgaggtccaagcaccttagggccctgagaagattgcatcgaccaccccctgcttctgctcccatcataagacgctgtcagcccgtgtgacagaagagtttcattgcttctgctgtccacagtacagcctgggcaagcagcccaatgcattagtgtgctatcctgcagcaaagctacaggacttctggagtggcagaagtcagggaagtaagaaaccttgctccctgccccccatatccaagcaagtggggaggaccgtgggtgaagatacctgtgcctggcggagaagattccagatggcatcctccttgccattcacacttcgtgccacaacggcatgagaagggacccgggccagatggcagtctttgaacttgtccactggcttccgagtgttgtctgggcagagtaactcatactcgtccctttcagcctcgtctgacaggtcctctgcagggaaggtgaggtgggagggagtctagataagccgactccagcagtaacctcgagctatagttccccttctccctatagaattttgagcttggggagatagctgacaaaactgagggtcagaaaggcaggggtttgctccagaacactcagaaaggtaaaggtagtgccccaaaagcctcagggggcagccgaggtgtgatcctcatcctaaatcacttaggccaccctggggttcccgtgcagctgctgcctggcaggccagagaggccaaaccagacccgtctgtttctgcggcatctctgcctggaaaagtcactttgcagagacaagctcagggggccaccaagggttgctcccttactcacatctctgggaagaataaaaatgacaaaaatgttaacaaggcagggaataaggcaggaaggtgagacactttccaacactgagtatatcaaaagaaggggaagaatggttttatgaatgagttcaggcaaatgtggaatatcatatataagttgcttcagaatgtgtaaagtgaaaaaaatcttgcccgagtcattttatgagattagtacaaccttgatgtcaaaatcagaaaaagtataggagggaagaattaaaagtttattttacttacgaacataaatgcaaaatttgtaaataacgtactaactaactcaatctcacagagtatttaaaaagctaatagattggaatgaaggtttaccagtgtattccattaacaaaagaatggctgaacatcaaaaaaactaaagtaatctgcatttaatggcagaaaaccatgagatcgtcttcatcttaatagatgcagaacgattgtttatgtgttcaacatctatttgtgtgtggtttttttttcagcctcagaaaaatagtaatagatagaatcggtaaagtttttttgtttgttttgagacggagtctcactctgttgcccagcctggaatgcagtggtgcgatctcagctcactgcatcctccatctcctggagtcaagagattctcttgcctcagcctcccaagtagctgggaccacaagcgcacgccaccaggcccagctaatttttgtatttttaatagagatggggtttcaccatgttggccaggctggtctcgaactcctgacctcatgtgatccacccgcctcagtctcccaaagtgctgggattacaggggtgagacaccacgcctggccataagttattggcttgataaatgccattaatctacagcaaaaaccttactaaaagaagaaaatgtagacattcaccgcaaaatcaggaacaaggcaaggatgcccactgttacaatgccagcacaattctagatatccagatcacacaatttacaaaagaaatgtgagatataaacactggaaggaaaaagacacactcttatttaaaaagatgatatcgtcatctacaaaaaaccaatgaaaccaacagaaactaataaaactactcagaggagtaacaagttataagagcaacctacaaaaatcagatgttatcctcattaacaataaccaaatagaaaccaatatggactataagatgttacaatagcaactaaaaccattaagtagctaataattagcctcccacaaagacacatcagacccacaaaggaaaaattttagttctatcaaagaaactaaaaagaggtgtgatcaaatgggggagatttagcatcaccatggactggacaacttaatgttataaatatgctgatttttcatggaacaatttaaattcagtacaattcgaatcaaaattaaagtatgattttttccagaaattcaacaaaataattctgaagttttagctgagtatatttgaaaaggaataataaagtgagaggggagagggagctctctctcattctctctctcttcctctcactggctctctctctttctctccaccagatagtaagacccattggtaagccacagtaacaaaagcagaaaaaatgcaaatacaccaatgaaataaaatagctcagaaactggtccacttggatatatacaaacttggtgtagaattggcttcacatatggcagaaaaaatatactttttttattgtaaggtaaattgcctcactgtaaaggggataaaatgctaaagccaaatctatatctgactttctaggtagagcacatataaatagatgaggaaggggatcttcaaatcttattttaggaaataattatgatttgggtgtgaagaagggcatctttgaaatatctcaaaactacaaaccaacaaggtgaggcttgtggatttgaccttatcaatatcaaggatttttgatcaacagagactaccgttgtcagatttttgactgagaagaggttttactaaagtttaaaatcagcaatagtttgatacctagatagaaggaacttctgtccttgaatcaaaatcatgcagaaacaaggtgtgaaactcaatttaaaaagtagtcaaatgtcacaaaataagaaagggaagcccaaacggctagcaaatatgttgaaatgatcaaactcaccagctgtcagagaaatgaaaattaaaaataaaacgaactatctattgcattacaaccatcattcggacaaaaagtatgaaagtcaaaaatacttctaactgaagttgtggggaaattagaacacttgcagagtgtcattccagacagcagcttggtgatcctgggtgcatgtggggtctgtctctggtggccctgggtgcatgtggaggtctgtttctggtggcctctgatgaatgcggggtctgtctctgatggtcctaggtgaatgtgggtgttgtctctttctctggtggtcctgggtggatgtggggtgtgtctctgatggtcctgagtgaatgtgggtgtctgtcactttctctagtggccctgggtggaatatagtagccctgtctctattggtcttgcatgaaatgtagtgagcttatgtccactagtcctgggtgcagtgtgtttagcctctacatactcatcaactgctttattataagtccaggagggacgctgtccagcaggtaagtaaggaacacaggtgaaggtatcagtcgtgtggctgcatgtggtagaggaaaagagagcacaacctctgtccatcactatggtgacagagaagtaaaaggtggatgtattccacggaacactcctcaactgttaggacccctgagctagacatgtatacaacaataccgataaacctctaaaacaaaatgctgagcagaaaacccaagtagcaggatttctaatgctcactaaaacctctatgaacccagaaaccggaaacacaaaccagcacaatctgttctgcatgagcacatgtgtcttggaggactggaggacgcattgccaagcacctaggcatgggtgtctatgaggggaagagaaaggcagtaggcacaggaggtttgaagaaaactgatcatttaaaatatgaaagatcataaaatcagagctgtgccctgtaggaatcttgaaaatggtctgccatgaacttaggaatctaattagctcaaaggtcagagtcatgatcaagtaagataaaaggggtcagtacccacggctcattaccctgctcttaccaaacactgtgctctctctgataaaagccacgtctccagccccgtctctcagacacctgtgaaaagagaaaccatcaggggtaagcacaggcagccctccccagcccctccctgtggaacagtagccctggcactcagcatctatgggtttctactccctgcagggcagggctctgaagctt

SEQ ID NO: 2673 - DNA, 2277 bp; single-stranded, linear
gagctcagaaattcaagaccagcctgggcaaggtagagagacccccatgtctacaaaaaataaaaaatgattagtcaggtgtggtggcccgcacctgtagttccagctactcaggacgctgaggtgggagaatgactcgagcccgtgagttgaggctgcagtgagccgagatcacaccactccagcctaggcaagagtgagaccctctctcaaaaaaaaaaaaaaaaaaaaaaaaaaaagaaccatcaaaatgttttgcacagcagtcacgccattttacatttctgccagcaatgtgcaccaggcttccagtttcttcacatcttcactaactcttatttcctttgctttaaactctaaccatcaaagtaggtgtaaagggtatctcactgtggtttgatttgcatttctctaatgactaatagtgttaagtatcatttcatgtgcatgttggccatttatatgtcattggagaaatgtctactcaaaccgtttgctcatttagaaacttaggtaggttggtctgagtgcagtggtgtttaaaactaatttttttttgagacaaagtctcactctgtcgcccaggctggaatgcaatggtgagatcttggctcactacaacctccatctcctgggttcaagcaattcttctgcctcagcctctcaagtagctgggattacaggcatgcgccaccacgcctggctaatttttgtatttttggtagagacgggggtttctccatgttggccaggctggtctcgaactcttgacctcaggtgatccacctgcctcggcctccacagggctaggattagaggtgtgagccaccgcaccaggccgtttaaaactaatggagcacaaccagttaccaatatctttgttccttctccactccctctgcttcaacttgactagcctaaaataaataaatttaaaaaactgggcacagtggctcacacctgtaatcccagcactttgggaggccgaggcaggaggattacttgagcataggagttcaagatcagcctgggcaactagtgaaaaaccatctcaaaaaagaaaaattagccaggcatggtggcatgcacctgtggtttcagctacttagagcagaggtggaggatcgcttgattctggagttcaaggttgcattgagctgtgatcgcgccagtgcactctcgcttgggtgacagagtaagaccttgtctcaaaaaatttaaaacaaaacaaaaaaaactggttatttgtctttttattggtgaattataagagttttaaaaaatatattctggaaacaaatcccttattagagatatgatttgcaaatattttctccaattttttttttttttaaagacaaagtttcactttgtcgcccaggctggtcttgattcctggcttcaagagatgctcttacctccacctcctgaagcccaaagggctggaattacagccagtgagcctgcacccagcctccaattctttagattttacattttagaaccaaaatgggttaaatacactgttctgtaatctgctcttttctttaatagtagttcatgtacatctttcaaggtccagagaaagctctcactttctccccgttttatttttccttccctcattctttttcactgctgcatagcattccattgtaattttgccactgtttattagaccagtcctctgctgagctttacagagcccttagttggatgttagtgagaaccatgacagcagtgagactgtcatctccctgacatgctgtcagcttttggatgatgtgaaaatgcaagcaggcacaggaaatgtctctaacttgcttacacttcctccctgaaccctgcggtttcacaactcctgcaggcacacctccctccccgcctgccagtgtcaccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcggtaggcaagggaggaggcaggggaagggacatgtgtctgtgaccagagaaactgcagggcttggtgcagctggagtaaacaaggagctgccccctaaaagtgggattggccttagggatatggggccccagggatcttggaaggagaaaggggagagcggggaaataaaag

SEQ ID NO: 2674 - DNA, 1520 bp; single-stranded, linear
gatcttggctcactacaacctccatctggtgggttcaagcaattcttctgcctcagcctctcaagtagctgggattacaggcatgcgccaccacgcccggctaatttttgtatttttggtagagacgggggtttctccatgttggccaggctggtctcgaactcttgacctcaggtgatccacctgcctcggcctcccacaggctaggattagaggtgtgagccaccgcaccaggccgtttaaaactaatggagcacaaccagttaccaatatctttgttccttctccactccctctgcttcacttgactagcctaaaataaataaatttaaaaaactgggcacagtggctcacacctgtaatcccagcactttgggaggccgaggcaggaggattacttgagcataggagttcaagatcagcctgggcaacatagtgaaaaaccatctcaaaaaagaaaaaattagccaggcatggtggcatgcacctgtggtttcagctacttaggagcagaggtgggaggatcgcttgattctgggagttcaaggttgcattgagctgtgatcgcgccagtgcactctcgcttgggtgacagagcaagaccttgtctcaaaaaatttaaaacaaaacaaaaaaaactggttatttgtctttttattgttgaattataagagttttaaaaaatatattctggaaacaaatcccttattagagatatgatttgcaaatattttctccaatttttttttttttaaagacaaagtttcactttggtgcccaggctggtcttcattcctggcttcaagagatgctcttacctccacctcctgaagccccaaagggctggaattacagccagtgagccactgcacccagcctccaattctttagattttacattttagaaccaaaatgggttaaatacactgttctgtaatctgctcttttctttaatagtagttcatgtacatctttcaaggtccagagaaagctctcactttctccccgttttatttttccttccctcattctttttcactgctgcatagcattccattgtaattttgccactgtttattagaccagtcctctgctgagctttacagagcccttagttgggatgttagtgagaaaccatgacagcagtggagactgtcatctccctgacatgctgtcagcttttggatgatgtgaaaatgcaagcaggcacaggaaatgtctctctaacttgcttacacttcctccctgaaccctgcggtttcacaactcctgcaggcacacctccctccccgcctgccagtgtcaccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcggtaggc

SEQ ID NO: 2675 - DNA, 2776 bp; single-stranded, linear
cagggcagactggtagcaaagcccccacgcccagccaggagcaccgccgcggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacggaaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttggccacagctcttgaggatgtcaccaattaaccagaaatccagttattttccgccctcaaaatgacagccatggccggccggtgcttctgggggctcgtcggggggacagctccactctgactggcacagtctttgcatggagacttgaggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaaataaaacttcaat

SEQ ID NO: 2676 - DNA, 2291 bp; single-stranded, linear; identical to SEQ ID NO: 2574

SEQ ID NO: 2677 - DNA, 8864 bp; single-stranded, linear
gagctcagaaattcaagaccagcctgggcaaggtagagagacccccatgtctacaaaaaataaaaaatgattagtcaggtgtggtggcccgcacctgtagttccagctactcaggacgctgaggtgggagaatgactcgagcccgtgagttgaggctgcagtgagccgagatcacaccactccagcctaggcaagagtgagaccctctctcaaaaaaaaaaaaaaaaaaaaaaaaaaaagaaccatcaaaatgttttgcacagcagtcacgccattttacatttctgccagcaatgtgcaccaggcttccagtttcttcacatcttcactaactcttatttcctttgctttaaactctaaccatcaaagtaggtgtaaagggtatctcactgtggtttgatttgcatttctctaatgactaatagtgttaagtatcatttcatgtgcatgttggccatttatatgtcattggagaaatgtctactcaaaccgtttgctcatttagaaacttaggtaggttggtctgagtgcagtggtgtttaaaactaatttttttttgagacaaagtctcactctgtcgcccaggctggaatgcaatggtgagatcttggctcactacaacctccatctcctgggttcaagcaattcttctgcctcagcctctcaagtagctgggattacaggcatgcgccaccacgcctggctaatttttgtatttttggtagagacgggggtttctccatgttggccaggctggtctcgaactcttgacctcaggtgatccacctgcctcggcctccacagggctaggattagaggtgtgagccaccgcaccaggccgtttaaaactaatggagcacaaccagttaccaatatctttgttccttctccactccctctgcttcaacttgactagcctaaaataaataaatttaaaaaactgggcacagtggctcacacctgtaatcccagcactttgggaggccgaggcaggaggattacttgagcataggagttcaagatcagcctgggcaactagtgaaaaaccatctcaaaaaagaaaaattagccaggcatggtggcatgcacctgtggtttcagctacttagagcagaggtggaggatcgcttgattctggagttcaaggttgcattgagctgtgatcgcgccagtgcactctcgcttgggtgacagagtaagaccttgtctcaaaaaatttaaaacaaaacaaaaaaaactggttatttgtctttttattggtgaattataagagttttaaaaaatatattctggaaacaaatcccttattagagatatgatttgcaaatattttctccaattttttttttttttaaagacaaagtttcactttgtcgcccaggctggtcttgattcctggcttcaagagatgctcttacctccacctcctgaagcccaaagggctggaattacagccagtgagcctgcacccagcctccaattctttagattttacattttagaaccaaaatgggttaaatacactgttctgtaatctgctcttttctttaatagtagttcatgtacatctttcaaggtccagagaaagctctcactttctccccgttttatttttccttccctcattctttttcactgctgcatagcattccattgtaattttgccactgtttattagaccagtcctctgctgagctttacagagcccttagttggatgttagtgagaaccatgacagcagtgagactgtcatctccctgacatgctgtcagcttttggatgatgtgaaaatgcaagcaggcacaggaaatgtctctaacttgcttacacttcctccctgaaccctgcggtttcacaactcctgcaggcacacctccctccccgcctgccagtgtcaccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcggtaggcaagggaggaggcaggggaagggacatgtgtctgtgaccagagaaactgcagggcttggtgcagctggagtaaacaaggagctgccccctaaaagtgggattggccttagggatatggggccccagggatcttggaaggagaaaggggagagcggggaaataaaaggatcttggctcactacaacctccatctggtgggttcaagcaattcttctgcctcagcctctcaagtagctgggattacaggcatgcgccaccacgcccggctaatttttgtatttttggtagagacgggggtttctccatgttggccaggctggtctcgaactcttgacctcaggtgatccacctgcctcggcctcccacaggctaggattagaggtgtgagccaccgcaccaggccgtttaaaactaatggagcacaaccagttaccaatatctttgttccttctccactccctctgcttcacttgactagcctaaaataaataaatttaaaaaactgggcacagtggctcacacctgtaatcccagcactttgggaggccgaggcaggaggattacttgagcataggagttcaagatcagcctgggcaacatagtgaaaaaccatctcaaaaaagaaaaaattagccaggcatggtggcatgcacctgtggtttcagctacttaggagcagaggtgggaggatcgcttgattctgggagttcaaggttgcattgagctgtgatcgcgccagtgcactctcgcttgggtgacagagcaagaccttgtctcaaaaaatttaaaacaaaacaaaaaaaactggttatttgtctttttattgttgaattataagagttttaaaaaatatattctggaaacaaatcccttattagagatatgatttgcaaatattttctccaatttttttttttttaaagacaaagtttcactttggtgcccaggctggtcttcattcctggcttcaagagatgctcttacctccacctcctgaagccccaaagggctggaattacagccagtgagccactgcacccagcctccaattctttagattttacattttagaaccaaaatgggttaaatacactgttctgtaatctgctcttttctttaatagtagttcatgtacatctttcaaggtccagagaaagctctcactttctccccgttttatttttccttccctcattctttttcactgctgcatagcattccattgtaattttgccactgtttattagaccagtcctctgctgagctttacagagcccttagttgggatgttagtgagaaaccatgacagcagtggagactgtcatctccctgacatgctgtcagcttttggatgatgtgaaaatgcaagcaggcacaggaaatgtctctctaacttgcttacacttcctccctgaaccctgcggtttcacaactcctgcaggcacacctccctccccgcctgccagtgtcaccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcggtaggccagggcagactggtagcaaagcccccacgcccagccaggagcaccgccgcggactccagcacaccgagggacatgctgggcctgcgccccccactgctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgccagcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacggaaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggttcttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagcacttggtgaagacaaggccgtcaggacccaccatgtctgccccatcacgcggccgagacatggcttggccacagctcttgaggatgtcaccaattaaccagaaatccagttattttccgccctcaaaatgacagccatggccggccggtgcttctgggggctcgtcggggggacagctccactctgactggcacagtctttgcatggagacttgaggagggcttgaggttggtgaggttaggtgcgtgtttcctgtgcaagtcaggacatcagtctgattaaaggtggtgccaatttatttacatttaaacttgtcagggtataaaatgacatcccattaattatattgttaatcaatcacgtgtatagaaaaaaaaataaaacttcaatctcgccctggtggggctgctctccctcgggtgcgtcctctctcaggagtgcacgaagttcaaggtcagcagctgccgggaatgcatcgagtcggggcccggctgcacctggtgccagaagctgaacttcacagggccgggggatcctgactccattcgctgcgacacccggccacagctgctcatgaggggctgtgcggctgacgacatcatggaccccacaagcctcgctgaaacccaggaagaccacaatgggggccagaagcagctgtccccacaaaaagtgacgctttacctgcgaccaggccaggcagcagcgttcaacgtgaccttccggcgggccaagggctaccccatcgacctgtactatctgatggacctctcctactccatgcttgatgacctcaggaatgtcaagaagctaggtggcgacctgctccgggccctcaacgagatcaccgagtccggccgcattggcttcgggtccttcgtggacaagaccgtgctgccgttcgtgaacacgcaccctgataagctgcgaaacccatgccccaacaaggagaaagagtgcccgcccccgtttgccttcaggcacgtgctgaagctgaccaacaactccaaccagtttcagaccgaggtcgggaagcagctgatttccggaaacctggatgcacccgagggtgggctggacgccatgatgcaggtcgccgcctgcccggaggaaatcggctggcgcaacgtcacgcggctgctggtgtttgccactgatgacggcttccatttcgcgggcgacggaaagctgggcgccatcctgacccccaacgacggccgctgtcacctggaggacaacttgtacaagaggagcaacgaattcgactacccatcggtgggccagctggcgcacaagctggctgaaaacaacatccagcccatcttcgcggtgaccagtaggatggtgaagacctacgagaaactcaccgagatcatccccaagtcagccgtgggggagctgtctgaggactccagcaatgtggtccatctcattaagaatgcttacaataaactctcctccagggtcttcctggatcacaacgccctccccgacaccctgaaagtcacctacgactccttctgcagcaatggagtgacgcacaggaaccagcccagaggtgactgtgatggcgtgcagatcaatgtcccgatcaccttccaggtgaaggtcacggccacagagtgcatccaggagcagtcgtttgtcatccgggcgctgggcttcacggacatagtgaccgtgcaggtccttccccagtgtgagtgccggtgccgggaccagagcagagaccgcagcctctgccatggcaagggcttcttggagtgcggcatctgcaggtgtgacactggctacattgggaaaaactgtgagtgccagacacagggccggagcagccaggagctggaaggaagctgccggaaggacaacaactccatcatctgctcagggctgggggactgtgtctgcgggcagtgcctgtgccacaccagcgacgtccccggcaagctgatatacgggcagtactgcgagtgtgacaccatcaactgtgagcgctacaacggccaggtctgcggcggcccggggagggggctctgcttctgcgggaagtgccgctgccacccgggctttgagggctcagcgtgccagtgcgagaggaccactgagggctgcctgaacccgcggcgtgttgagtgtagtggtcgtggccggtgccgctgcaacgtatgcgagtgccattcaggctaccagctgcctctgtgccaggagtgccccggctgcccctcaccctgtggcaagtacatctcctgcgccgagtgcctgaagttcgaaaagggcccctttgggaagaactgcagcgcggcgtgtccgggcctgcagctgtcgaacaaccccgtgaagggcaggacctgcaaggagagggactcagagggctgctgggtggcctacacgctggagcagcaggacgggatggaccgctacctcatctatgtggatgagagccgagagtgtgtggcaggccccaacatcgccgccatcgtcgggggcaccgtggcaggcatcgtgctgatcggcattctcctgctggtcatctggaaggctctgatccacctgagcgacctccgggagtacaggcgctttgagaaggagaagctcaagtcccagtggaacaatgataatccccttttcaagagcgccaccacgacggtcatgaaccccaagtttgctgagagttaggagca

SEQ ID NO: 2678 - DNA, 1539 bp; single-stranded, linear
ggaattccgggcccggtctttcctcccgccgccgccggcctggtcccggggactggcctccacgtccgactcgtccgagctgaagcccagcagcactttgctgccagccgcgggggcggcggaggcgcccccgggccctcccaggaggctctctgggccagaggccgagattcggcacaggcccccaggagtccgtaagtaggagaggtcgcccgagaccggccggacccccatccccgcggccgccgccgccgctggtcccgcggctgcgaccgtggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgt

SEQ ID NO: 2679 - DNA, 1550 bp; single-stranded, linear
tggttaacgccagggttttcccagtcacgaacgttgtaaaacgacggccagtgccaagctaaaattaaccttcactaaagggaataagcttgcggccgcttcgggtttccggaggggccggagggcgggcgagggcgtcacgtgcgcgccgcccgcgggccggttggtccccgggcgggggaggggccgtgcgcagcctgggtcggggtcgggccggggtcggcacctgggacatccctgagggaagggccgggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcccttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtccgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaacaacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcacctt

SEQ ID NO: 2680 - DNA, 3089 bp; single-stranded, linear
ggaattccgggcccggtctttcctcccgccgccgccggcctggtcccggggactggcctccacgtccgactcgtccgagctgaagcccagcagcactttgctgccagccgcgggggcggcggaggcgcccccgggccctcccaggaggctctctgggccagaggccgagattcggcacaggcccccaggagtccgtaagtaggagaggtcgcccgagaccggccggacccccatccccgcggccgccgccgccgctggtcccgcggctgcgaccgtggcggctgccgctggaaaatgtctcaggagaggcccacgttctaccggcaggagctgaacaagacaatctgggaggtgcccgagcgttaccagaacctgtctccagtgggctctggcgcctatggctctgtgtgtgctgcttttgacacaaaaacggggttacgtgtggcagtgaagaagctctccagaccatttcagtccatcattcatgcgaaaagaacctacagagaactgcggttacttaaacatatgaaacatgaaaatgtgattggtctgttggacgtttttacacctgcaaggtctctggaggaattcaatgatgtgtatctggtgacccatctcatgggggcagatctgaacaacattgtgaaatgtcagaagcttacagatgaccatgttcagttccttatctaccaaattctccgaggtctaaagtatatacattcagctgacataattcacagggacctaaaacctagtaatctagctgtgaatgaagactgtgagctgaagattctggattttggactggctcggcacacagatgatgaaatgacaggctacgtggccactaggtggtacagggctcctgagatcatgctgaactggatgcattacaaccagacagttgatatttggtcagtgggatgcataatggccgagctgttgactggaagaacattgtttcctggtacagaccatattgatcagttgaagctcattttaagactcgttggaaccccaggggctgagcttttgaagaaaatctcctcagagtctgcaagaaactatattcagtctttgactcagatgccgaagatgaactttgcgaatgtatttattggtgccaatcccctggctgtcgacttgctggagaagatgcttgtattggactcagataagagaattacagcggcccaagcccttgcacatgcctactttgctcagtaccacgatcctgatgatgaaccagtggccgatccttatgatcagtcctttgaaagcagggacctccttatagatgagtggaaaagcctgacctatgatgaagtcatcagctttgtgccaccaccccttgaccaagaagagatggagtcctgagcacctggtttctgttctgttgatcccacttcactgtgaggggaaggccttttcacgggaactctccaaatattattcaagtgcctcttgttgcagagatttcctccatggtggaagggggtgtgcgtgcgtgtgcgtgcgtgttagtgtgtgtgcatgtgttggttaacgccagggttttcccagtcacgaacgttgtaaaacgacggccagtgccaagctaaaattaaccttcactaaagggaataagcttgcggccgcttcgggtttccggaggggccggagggcgggcgagggcgtcacgtgcgcgccgcccgcgggccggttggtccccgggcgggggaggggccgtgcgcagcctgggtcggggtcgggccggggtcggcacctgggacatccctgagggaagggccgggagcgggagcgccccagcggccggcgggcgggcgggcgagcggacgagcggcgcggagccggcccgaggcgcgcgccgagggagccccgtccccggtcgtgggggcaccgcccgcaggctctgcggggtgggcagctcccgggcctgccatgagctctccgccgcccgcccgcagtggcttttaccgccaggaggtgaccaagacggcctgggaggtgcgcgccgtgtaccgggacctgcagcccgtgggctcgggcgcctacggcgcggtgtgctcggccgtggacggccgcaccggcgctaaggtggccatcaagaagctgtatcggcccttccagtccgagctgttcgccaagcgcgcctaccgcgagctgcgcctgctcaagcacatgcgccacgagaacgtgatcgggctgctggacgtattcactcctgatgagaccctggatgacttcacggacttttacctggtgatgccgttcatgggcaccgacctgggcaagctcatgaaacatgagaagctaggcgaggaccggatccagttcctcgtgtaccagatgctgaaggggctgaggtatatccacgctgccggcatcatccacagagacctgaagcccggcaacctggctgtgaacgaagactgtgagctgaagatcctggacttcggcctggccaggcaggcagacagtgagatgactgggtacgtggtgacccggtggtaccgggctcccgaggtcatcttgaattggatgcgctacacgcagacggtggacatctggtccgtgggctgcatcatggcggagatgatcacaggcaagacgctgttcaagggcagcgaccacctggaccagctgaaggagatcatgaaggtgacggggacgcctccggctgagtttgtgcagcggctgcagagcgatgaggccaagaacaacatgaagggcctccccgaattggagaagaaggattttgcctctatcctgaccaatgcaagccctctggctgtgaacctcctggagaagatgctggtgctggacgcggagcagcgggtgacggcaggcgaggcgctggcccatccctacttcgagtccctgcacgacacggaagatgagccccaggtccagaagtatgatgactcctttgacgacgttgaccgcacactggatgaatggaagcgtgttacttacaaagaggtgctcagcttcaagcctccccggcagctgggggccagggtctccaaggagacgcctctgtgaagatctctgggctccggggtggcagtgaggaccaccttcacctt

SEQ ID NO: 2681 - DNA, 2400 bp; single-stranded, linear
ctcgatcaaaccttttttttatggtacacaatagtcacagtacttttccatataaaacaggtttagtggtcttaatttagtttggcacatttaatacactcccatgaccagcatcccaaatgtacctatccgttttattttattgtctcagaattgtcagttatttaataaattatgtaacttttttccttatgctcagatttgcacttctttctaaaactctgcccatccttaaagtcccagattctccttgaacttttttttttgactttccaagtacatggaactcttcactctatcctgctatataaggtgacagaatttccactatgggatagatggagttcaattcctttgagtttaaaataatctaaatataattattccttatgccctgtttttccctcacttttgtatccaaatctcttttcagacaacagaacaattaatgtctgataaggaagacaatgatgatgatcacttcaaaatgaattcaggattgtaatgtaaaattttagtactctctcacagtatggattctaacatggcttctaacccaaactaacattagtagctctaactataaacttcaaatttcagtagatgcaacctactcctttaaaatgaaacagaagattgaaattattaaattatcaaaaagaaaatgatccacgctcttagttgaaatttcatgtaagattccatgcaataaataggagtgccataaatggaatgatgaaatatgactagaggaggagaaaggctcctagatgagatgggattttaggcatccgtgtctcatgaggaatcagttgtgtcactaggcaaaacagtaaaaaaaaaaacctccaagtgagtctcttatttatttttttcttataagacttctacaaattgaggtacctggtgtagttttatttcaggttttatgctgtcattttcctgtaatgctaaggacttaggacataactgaattttctattttccacttcttttctggtgtgtgtgtatatatatatgtatatatacacacacacatatacatatatatattttttagtatctcaccctcacatgctcctccctgagcactacccatgatagatgttaaacaaaagcaaagatgaaattccaactgtcaaaatcccccctccatctaattaatccctcacccaactatgttccaaaacgagaatagaaaattagccccaataagcccaggcaactgaaaagtaaatgctatgttgtactttgatccatggtcacaactcataatcttggaaaagtggacagaaaagacaaaagagtgaactttaaaactcgaatttattttaccagtatctcctatgaagggctagtaaccaaaataatccacgcatcagggagagaaatgccttaaggcatacgttttggacatttagcgtccctgcaaattctggccatcgccgcttcctttgtccatcagaaggcaggaaactttatattggtgacccgtggagctcacattaactatttacagggtaactgcttaggaccagtattatgaggagaatttacctttcccgcctctctttccaagaaacaaggagggggtgaaggtacggagaacagtatttcttctgttgaaagcaacttagctacaaagataaattacagctatgtacactgaaggtagctatttcattccacaaaataagagttttttaaaaagctatgtatgtatgtgctgcatatagagcagatatacagcctattaagcgtcgtcactaaaacataaaacatgtcagcctttcttaaccttactcgccccagtctgtcccgacgtgacttcctcgaccctctaaagacgtacagaccagacacggcggcggcggcgggagaggggattccctgcggccccggacctcagggccgctcagattcctggagaggaagccaagtgtccttctgccctcccccggtatcccatccaaggcgatcagtccacaactggctctcggaagcactcgggcaaagactgcgaagaagaaaagacatctggcggaaacctgtgcgcctggggcggtggaactcggggaggagagggagggatcagacaggagagtggggactaccccctctgctcccaaattggggcagcttcctgggtttccgattttctcatttccgtgggtaaaaaaccctgcccccaccggcttacgcaatttttttaaggggagaggagggaaaaatttgtggggggtacgaaaaggcggaaagaaacagtcatttcgtcacatgggcttggttttcagtcttataaaaaggaaggttctctcggttagcgaccaattgtcatacgacttgcagtgagcgtcaggagcacgtccaggaactcctcagcagcgcctccttcagctc

SEQ ID NO: 2682 - DNA, 3387 bp; single-stranded, linear
gtccaggaactcctcagcagcgcctccttcagctccacagccagacgccctcagacagcaaagcctacccccgcgccgcgccctgcccgccgctgcgatgctcgcccgcgccctgctgctgtgcgcggtcctggcgctcagccatacagcaaatccttgctgttcccacccatgtcaaaaccgaggtgtatgtatgagtgtgggatttgaccagtataagtgcgattgtacccggacaggattctatggagaaaactgctcaacaccggaatttttgacaagaataaaattatttctgaaacccactccaaacacagtgcactacatacttacccacttcaagggattttggaacgttgtgaataacattcccttccttcgaaatgcaattatgagttatgtgttgacatccagatcacatttgattgacagtccaccaacttacaatgctgactatggctacaaaagctgggaagccttctctaacctctcctattatactagagcccttcctcctgtgcctgatgattgcccgactcccttgggtgtcaaaggtaaaaagcagcttcctgattcaaatgagattgtgggaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtggacttaaatcatatttacggtgaaactctggctagacagcgtaaactgcgccttttcaaggatggaaaaatgaaatatcagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgagggaacacaacagagtatgcgatgtgcttaaacaggagcatcctgaatggggtgatgagcagttgttccagacaagcaggctaatactgataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataaggacgaaagtaaagatgtttgaatacttaaacactatcacaagatgccaaaatgctgaaagtttttacactgtcgatgtttccaatgcatcttccatgatgcattagaagtaactaatgtttgaaattttaaagtacttttgggtatttttctgtcatcaaacaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagatgaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatctcaaaataagaatatcctgttgagatattccagaatctgtttatatggctggtaacatgtaaaaaccccataaccccgccaaaaggggtcctacccttgaacataaagcaataaccaaaggagaaaagcccaaattattggttccaaatttagggtttaaactttttgaagcaaacttttttttagccttgtgcactgcagacctggtactcagattttgctatgaggttaatgaagtaccaagctgtgcttgaataacgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcaaacacttcgtttctcctattttgttttactagttttaagatcagagttcactttctttggactctgcctatattttcttacctgaacttttgcaagttttcaggtaaacctcagctcaggactgctatttagctcctcttaagaagattaaaaaaaaaaaaaaag

SEQ ID NO: 2683 - DNA, 9453 bp; single-stranded, linear
gagctcacattaactatttacagggtaactgcttaggaccagtattatgaggagaatttacctttcccgcctctctttccaagaaacaaggagggggtgaaggtacggagaacagtatttcttctgttgaaagcaacttagctacaaagataaattacagctatgtacactgaaggtagctatttcattccacaaaataagagttttttaaaaagctatgtatgtatgtgctgcatatagagcagatatacagcctattaagcgtcgtcactaaaacataaaacatgtcagcctttcttaaccttactcgccccagtctgtcccgacgtgacttcctcgaccctctaaagacgtacagaccagacacggcggcggcggcgggagaggggattccctgcgcccccggacctcagggccgctcagattcctggagaggaagccaagtgtccttctgccctcccccggtatcccatccaaggcgatcagtccagaactggctctcggaagcgctcgggcaaagactgcgaagaagaaaagacatctggcggaaacctgtgcgcctggggcggtggaactcggggaggagagggagggatcagacaggagagtggggactaccccctctgctcccaaattggggcagcttcctgggtttccgattttctcatttccgtgggtaaaaaaccctgcccccaccgggcttacgcaatttttttaaggggagaggagggaaaaaatttgtgggggggtacgaaaaggcggaaagaaacagtcattcacatgggcttggttttcagtcttataaaaaggaaggttctctcggttagcgaccaattgtcatacgacttgcagtgagcgtcaggagcacgtccaggaactcctcagcagcgcctccttcagctccacagccagacgccctcagacagcaaagcctacccccgcgccgcgccctgcccgccgctcggatgctcgcccgcgccctgctgctgtgcgcggtcctggcgctcagccatacaggtgagtacctggcgccgcgcaccggggactccggttccacgcacccgggcagagtttccgctctgacctcctgggtctatcccagtactccgacttctctccgaatagagaagctacgtgacttgggaaagagcttggaccgctagagtccgaaagaactccgtggatattccagctttcccacaagcactgatcattatgagccagttacttaaccgatctgagacactctcacctcctaaatagggatagatgatactaatttgcaggttgtcattatgataagacaggatctgatcaatatatgtgaattgtttatatttggaacctttttattgagtggaagaagttgttttaaatattctagtcagttctttcctgctcccaggaaagcccggattatgttttaagataagcaaaatgtcttaaaagtaagctgttttactttgaatttttccctaaatgttgattagtgtactagatccattttaatttggaaagtgaagtgctacttatttgaacttcttaaaaatgctaattttaacatctaaagagttaactaagaaaagcttagtaacatgatgtaccaagttgaatatgctgttatccttatttagaatagaaaattggtatttctacgttttatccattctaaggcaggttaaaaaattgtatttccatgactacctatatatttcttgaatttattattgtaaagttgattcatagtcaaacaattaaatgtttaaattaagattaagacactagagaatgatttatttgctgtcctttaattgcagcaaatccttgctgttcccacccatgtcaaaaccgaggtgtatgtatgagtgtgggatttgaccagtataagtgcgattgtacccggacaggattctatggagaaaactgctcaacacgtaagtttgtcctttggttgcctcattaggagtggggctggatacagttatcattgtatagatttgtgtcttataatgagtcccattaatttctccctccctttcttcgtcttcttgcagcggaatttttgacaagaataaaattatttctgaaacccactccaaacacagtgcactacatacttacccacttcaagggattttggaacgttgtgaataacattcccttccttcgaaatgcaattatgagttatgtcttgacatgtaagtacaagtgtctttctaaggtttttagccttctcaaagaaaaatatgctttataatactgtaagcctaatctaaaaacatatttccaagcttatcaaaaagactttaagatagcttttaagtttgccttccatcttaatcgccaaaaatattgacatttagtcccatccagtttatacagtctgctcacaactctgtatacctcttctaacctttactgtttggtcagtttgtggaggtagcatggtccagctgtttattgaatgcccatgggccacagaattgttctgaacatgtagcacccattaaaataaatttggatttggatcagcaagaaaataactttccatgattctaaagtgggtgccatactcagccattcctttcataggcctcttggatagtgagcagatggctacctgaaaaatcaatattgccagattataatgtgcagagtatatgtattttattaaagatgtatttcaagtggccattagactataaagtgtagttgtttaaaaatagattttttttattttggagttacattcaacctcaggtgccactttccacattttacaataaaaataatggttgatttacttaacaaatgagaataaataaaacatttttttctttgaaaatttcagccagatcacatttgattgacagtccaccaacttacaatgctgactatggctacaaaagctgggaagccttctctaacctctcctattatactagagcccttcctcctgtgcctgatgattgcccgactcccttgggtgtcaaaggtgagtaagaagaatccattagagatgtattaactataagacgggctgcattgctgccaaaaaaaaaaattgaccttagactaccatttatttattaacaaaagcagtttttacttttagcatggttatctatgggtattttttaaagtatgagtctatataaactattatgtaaaagcaaatgagcgtcttggtataatgtcttaatattttcaaattatttctttagaaatgaaataattctaattaaaatagataaaatcattcagtaagaagttgttccaccatatcttagaactgttgtttatattatgatcctattcacaattgtaattctcatataaatgaagaattcttggtagattgacagtcaccatctcctttcttgaatacatagatggattcttaccttagctttctcatttttcaggtaaaaagcagcttcctgattcaaatgagattgtggaaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtaagatagagttaatatcttagagttagtaaaattataccaaatcatagtcaagggctaacattaaaggagatatacagatagatagatccaaataacttatccactttttttaaaaagaagtcttatctataaaaaccttaaaggaattttccatttacttcactggtctagtaaaattatacacacacacagacatgcacacacatatataaacattcacacacatacatatgtacaggtattgttatttgtaatttgacccttgtattttttagtttaaaatgttagtactgcaaaatgttatgtcctcaaaaacacattgtaccatgattatgccgctttcaatattgtaaagtgaggtttttgccgcattattattttttggatttcaatagcatagcttcaagttattcgtaagaattttttataaataatacatttttatacttttttataattaccatatcatcatagtgaagtatataatatatatgatataagctcaatatagtatattaattccgttaaacacaaagacatatcagtttgtagctttggtggataaacaaattaatttagcaattcatggctatgaaaaatgtatattttatttaaaaattttaaagaaagctaaatgatcaaattatttaatgatgaattatatgatagacactttatataagaaaaacttcaacagcaacaaattaaaattttttcatcattttctaggtggacttaaatcatatttacggtgaaactctggctagacagcgtaaactgcgccttttcaaggatggaaaaatgaaatatcaggtatgcttcctttgactattaagacttagttattaccgcttatacccatattttaaaatccctaaaaatgtgttccttaactttttaactgatgtttatttatttatttatttttttagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggtaaacaagaaaatgatttatataaaaccctcttccccagggaaaattagtgtgctatctttgttatgttttgagtaaatgacaagatgtggtaaatgaaaactcacacattctatatacattaaatatgtaagcatgactgataaaatagctatcttttgatactgacaaggaagaaaacagaaatgaaggaatagcaaattttaaaaattgcattccagttgcttgaaagcttgtgatcagatgcaataaatgtttttattatttattttgtgcaaataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggtaagcattattattgaaaaccaaaacaaaagactagtcagtaactttagaatttctgccacggaaattatttttcttaaacttactaaaagagtagttagttatattgctagtaaaattattttattgatataagaagcctaactttgtttgaaaagtctaaacttttagtctagtctacagttgtcagacaaatagcaaattgtacccctaccttaaaaatattttcaaaaagtatctataatcttataggaataaatattttaggcttgaatactagtgttatttttgaaatgtaaaaaggcaaattagttctaggctggtgtcccattgaattttaagcagagctcctgttgaaatgtaggtaagcatctttccagcaaataaaaattgtctccgctgggagtttcagttttacctgatttgtacctaaggcaagctgaatacaaacagtaaatatgcctaaaattcttgttttacaactaattttactttccacaggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggtaagaaacagtttctaaacttcttcgttttttgtttgtttgtttgtttttgttgtttttggttttcttttcgagatggagccgccctctgtcacccaggctggagtgcagtggcgccatctcggctcactgcaacctccgcctcctgggttcaagcaattctcctgcctcaacttcctgagtagctgggactacaggctcacgtcgcacgcatggataattttttgtattttcagtatagacggggtttcaccgtgttagccaggctggtctcaaactcctgacctagtgatccgccggcttcggcctcccgaagtgctgggattacaggcgtgagccaccgcgcctggcccctaaacttcttaaaagaatcaggggtcaaatggaaacagagaagttggcagcaaattgagcaaaagaatcaaactgttttttattttgtgaagtttgacattggttgtatctctgtcttcatcgccttcacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactatcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagatgaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatctcaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataacgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatattttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtttagaatgtttaaggttaagaaagaaatagtcaatatgcttgtataaaacactgttcactgttttttttaaaaaaaaaacttgatttgttattaacattgatctgctgacaaaacctgggaatttgggttgtgtatgcgaatgtttcagtgcctcagacaaatgtgtatttaacttatgtaaaagataagtctggaaataaatgtctgtttatttttgtactatttaaaaaaaaaaaaaaaaatcgatgtcgactcgagtc

SEQ ID NO: 2684 - DNA, 15240 bp; single-stranded, linear
ctcgatcaaaccttttttttatggtacacaatagtcacagtacttttccatataaaacaggtttagtggtcttaatttagtttggcacatttaatacactcccatgaccagcatcccaaatgtacctatccgttttattttattgtctcagaattgtcagttatttaataaattatgtaacttttttccttatgctcagatttgcacttctttctaaaactctgcccatccttaaagtcccagattctccttgaacttttttttttgactttccaagtacatggaactcttcactctatcctgctatataaggtgacagaatttccactatgggatagatggagttcaattcctttgagtttaaaataatctaaatataattattccttatgccctgtttttccctcacttttgtatccaaatctcttttcagacaacagaacaattaatgtctgataaggaagacaatgatgatgatcacttcaaaatgaattcaggattgtaatgtaaaattttagtactctctcacagtatggattctaacatggcttctaacccaaactaacattagtagctctaactataaacttcaaatttcagtagatgcaacctactcctttaaaatgaaacagaagattgaaattattaaattatcaaaaagaaaatgatccacgctcttagttgaaatttcatgtaagattccatgcaataaataggagtgccataaatggaatgatgaaatatgactagaggaggagaaaggctcctagatgagatgggattttaggcatccgtgtctcatgaggaatcagttgtgtcactaggcaaaacagtaaaaaaaaaaacctccaagtgagtctcttatttatttttttcttataagacttctacaaattgaggtacctggtgtagttttatttcaggttttatgctgtcattttcctgtaatgctaaggacttaggacataactgaattttctattttccacttcttttctggtgtgtgtgtatatatatatgtatatatacacacacacatatacatatatatattttttagtatctcaccctcacatgctcctccctgagcactacccatgatagatgttaaacaaaagcaaagatgaaattccaactgtcaaaatcccccctccatctaattaatccctcacccaactatgttccaaaacgagaatagaaaattagccccaataagcccaggcaactgaaaagtaaatgctatgttgtactttgatccatggtcacaactcataatcttggaaaagtggacagaaaagacaaaagagtgaactttaaaactcgaatttattttaccagtatctcctatgaagggctagtaaccaaaataatccacgcatcagggagagaaatgccttaaggcatacgttttggacatttagcgtccctgcaaattctggccatcgccgcttcctttgtccatcagaaggcaggaaactttatattggtgacccgtggagctcacattaactatttacagggtaactgcttaggaccagtattatgaggagaatttacctttcccgcctctctttccaagaaacaaggagggggtgaaggtacggagaacagtatttcttctgttgaaagcaacttagctacaaagataaattacagctatgtacactgaaggtagctatttcattccacaaaataagagttttttaaaaagctatgtatgtatgtgctgcatatagagcagatatacagcctattaagcgtcgtcactaaaacataaaacatgtcagcctttcttaaccttactcgccccagtctgtcccgacgtgacttcctcgaccctctaaagacgtacagaccagacacggcggcggcggcgggagaggggattccctgcggccccggacctcagggccgctcagattcctggagaggaagccaagtgtccttctgccctcccccggtatcccatccaaggcgatcagtccacaactggctctcggaagcactcgggcaaagactgcgaagaagaaaagacatctggcggaaacctgtgcgcctggggcggtggaactcggggaggagagggagggatcagacaggagagtggggactaccccctctgctcccaaattggggcagcttcctgggtttccgattttctcatttccgtgggtaaaaaaccctgcccccaccggcttacgcaatttttttaaggggagaggagggaaaaatttgtggggggtacgaaaaggcggaaagaaacagtcatttcgtcacatgggcttggttttcagtcttataaaaaggaaggttctctcggttagcgaccaattgtcatacgacttgcagtgagcgtcaggagcacgtccaggaactcctcagcagcgcctccttcagctcgtccaggaactcctcagcagcgcctccttcagctccacagccagacgccctcagacagcaaagcctacccccgcgccgcgccctgcccgccgctgcgatgctcgcccgcgccctgctgctgtgcgcggtcctggcgctcagccatacagcaaatccttgctgttcccacccatgtcaaaaccgaggtgtatgtatgagtgtgggatttgaccagtataagtgcgattgtacccggacaggattctatggagaaaactgctcaacaccggaatttttgacaagaataaaattatttctgaaacccactccaaacacagtgcactacatacttacccacttcaagggattttggaacgttgtgaataacattcccttccttcgaaatgcaattatgagttatgtgttgacatccagatcacatttgattgacagtccaccaacttacaatgctgactatggctacaaaagctgggaagccttctctaacctctcctattatactagagcccttcctcctgtgcctgatgattgcccgactcccttgggtgtcaaaggtaaaaagcagcttcctgattcaaatgagattgtgggaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtggacttaaatcatatttacggtgaaactctggctagacagcgtaaactgcgccttttcaaggatggaaaaatgaaatatcagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgagggaacacaacagagtatgcgatgtgcttaaacaggagcatcctgaatggggtgatgagcagttgttccagacaagcaggctaatactgataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataaggacgaaagtaaagatgtttgaatacttaaacactatcacaagatgccaaaatgctgaaagtttttacactgtcgatgtttccaatgcatcttccatgatgcattagaagtaactaatgtttgaaattttaaagtacttttgggtatttttctgtcatcaaacaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagatgaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatctcaaaataagaatatcctgttgagatattccagaatctgtttatatggctggtaacatgtaaaaaccccataaccccgccaaaaggggtcctacccttgaacataaagcaataaccaaaggagaaaagcccaaattattggttccaaatttagggtttaaactttttgaagcaaacttttttttagccttgtgcactgcagacctggtactcagattttgctatgaggttaatgaagtaccaagctgtgcttgaataacgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcaaacacttcgtttctcctattttgttttactagttttaagatcagagttcactttctttggactctgcctatattttcttacctgaacttttgcaagttttcaggtaaacctcagctcaggactgctatttagctcctcttaagaagattaaaaaaaaaaaaaaaggagctcacattaactatttacagggtaactgcttaggaccagtattatgaggagaatttacctttcccgcctctctttccaagaaacaaggagggggtgaaggtacggagaacagtatttcttctgttgaaagcaacttagctacaaagataaattacagctatgtacactgaaggtagctatttcattccacaaaataagagttttttaaaaagctatgtatgtatgtgctgcatatagagcagatatacagcctattaagcgtcgtcactaaaacataaaacatgtcagcctttcttaaccttactcgccccagtctgtcccgacgtgacttcctcgaccctctaaagacgtacagaccagacacggcggcggcggcgggagaggggattccctgcgcccccggacctcagggccgctcagattcctggagaggaagccaagtgtccttctgccctcccccggtatcccatccaaggcgatcagtccagaactggctctcggaagcgctcgggcaaagactgcgaagaagaaaagacatctggcggaaacctgtgcgcctggggcggtggaactcggggaggagagggagggatcagacaggagagtggggactaccccctctgctcccaaattggggcagcttcctgggtttccgattttctcatttccgtgggtaaaaaaccctgcccccaccgggcttacgcaatttttttaaggggagaggagggaaaaaatttgtgggggggtacgaaaaggcggaaagaaacagtcattcacatgggcttggttttcagtcttataaaaaggaaggttctctcggttagcgaccaattgtcatacgacttgcagtgagcgtcaggagcacgtccaggaactcctcagcagcgcctccttcagctccacagccagacgccctcagacagcaaagcctacccccgcgccgcgccctgcccgccgctcggatgctcgcccgcgccctgctgctgtgcgcggtcctggcgctcagccatacaggtgagtacctggcgccgcgcaccggggactccggttccacgcacccgggcagagtttccgctctgacctcctgggtctatcccagtactccgacttctctccgaatagagaagctacgtgacttgggaaagagcttggaccgctagagtccgaaagaactccgtggatattccagctttcccacaagcactgatcattatgagccagttacttaaccgatctgagacactctcacctcctaaatagggatagatgatactaatttgcaggttgtcattatgataagacaggatctgatcaatatatgtgaattgtttatatttggaacctttttattgagtggaagaagttgttttaaatattctagtcagttctttcctgctcccaggaaagcccggattatgttttaagataagcaaaatgtcttaaaagtaagctgttttactttgaatttttccctaaatgttgattagtgtactagatccattttaatttggaaagtgaagtgctacttatttgaacttcttaaaaatgctaattttaacatctaaagagttaactaagaaaagcttagtaacatgatgtaccaagttgaatatgctgttatccttatttagaatagaaaattggtatttctacgttttatccattctaaggcaggttaaaaaattgtatttccatgactacctatatatttcttgaatttattattgtaaagttgattcatagtcaaacaattaaatgtttaaattaagattaagacactagagaatgatttatttgctgtcctttaattgcagcaaatccttgctgttcccacccatgtcaaaaccgaggtgtatgtatgagtgtgggatttgaccagtataagtgcgattgtacccggacaggattctatggagaaaactgctcaacacgtaagtttgtcctttggttgcctcattaggagtggggctggatacagttatcattgtatagatttgtgtcttataatgagtcccattaatttctccctccctttcttcgtcttcttgcagcggaatttttgacaagaataaaattatttctgaaacccactccaaacacagtgcactacatacttacccacttcaagggattttggaacgttgtgaataacattcccttccttcgaaatgcaattatgagttatgtcttgacatgtaagtacaagtgtctttctaaggtttttagccttctcaaagaaaaatatgctttataatactgtaagcctaatctaaaaacatatttccaagcttatcaaaaagactttaagatagcttttaagtttgccttccatcttaatcgccaaaaatattgacatttagtcccatccagtttatacagtctgctcacaactctgtatacctcttctaacctttactgtttggtcagtttgtggaggtagcatggtccagctgtttattgaatgcccatgggccacagaattgttctgaacatgtagcacccattaaaataaatttggatttggatcagcaagaaaataactttccatgattctaaagtgggtgccatactcagccattcctttcataggcctcttggatagtgagcagatggctacctgaaaaatcaatattgccagattataatgtgcagagtatatgtattttattaaagatgtatttcaagtggccattagactataaagtgtagttgtttaaaaatagattttttttattttggagttacattcaacctcaggtgccactttccacattttacaataaaaataatggttgatttacttaacaaatgagaataaataaaacatttttttctttgaaaatttcagccagatcacatttgattgacagtccaccaacttacaatgctgactatggctacaaaagctgggaagccttctctaacctctcctattatactagagcccttcctcctgtgcctgatgattgcccgactcccttgggtgtcaaaggtgagtaagaagaatccattagagatgtattaactataagacgggctgcattgctgccaaaaaaaaaaattgaccttagactaccatttatttattaacaaaagcagtttttacttttagcatggttatctatgggtattttttaaagtatgagtctatataaactattatgtaaaagcaaatgagcgtcttggtataatgtcttaatattttcaaattatttctttagaaatgaaataattctaattaaaatagataaaatcattcagtaagaagttgttccaccatatcttagaactgttgtttatattatgatcctattcacaattgtaattctcatataaatgaagaattcttggtagattgacagtcaccatctcctttcttgaatacatagatggattcttaccttagctttctcatttttcaggtaaaaagcagcttcctgattcaaatgagattgtggaaaaattgcttctaagaagaaagttcatccctgatccccagggctcaaacatgatgtttgcattctttgcccagcacttcacgcatcagtttttcaagacagatcataagcgagggccagctttcaccaacgggctgggccatggggtaagatagagttaatatcttagagttagtaaaattataccaaatcatagtcaagggctaacattaaaggagatatacagatagatagatccaaataacttatccactttttttaaaaagaagtcttatctataaaaaccttaaaggaattttccatttacttcactggtctagtaaaattatacacacacacagacatgcacacacatatataaacattcacacacatacatatgtacaggtattgttatttgtaatttgacccttgtattttttagtttaaaatgttagtactgcaaaatgttatgtcctcaaaaacacattgtaccatgattatgccgctttcaatattgtaaagtgaggtttttgccgcattattattttttggatttcaatagcatagcttcaagttattcgtaagaattttttataaataatacatttttatacttttttataattaccatatcatcatagtgaagtatataatatatatgatataagctcaatatagtatattaattccgttaaacacaaagacatatcagtttgtagctttggtggataaacaaattaatttagcaattcatggctatgaaaaatgtatattttatttaaaaattttaaagaaagctaaatgatcaaattatttaatgatgaattatatgatagacactttatataagaaaaacttcaacagcaacaaattaaaattttttcatcattttctaggtggacttaaatcatatttacggtgaaactctggctagacagcgtaaactgcgccttttcaaggatggaaaaatgaaatatcaggtatgcttcctttgactattaagacttagttattaccgcttatacccatattttaaaatccctaaaaatgtgttccttaactttttaactgatgtttatttatttatttatttttttagataattgatggagagatgtatcctcccacagtcaaagatactcaggcagagatgatctaccctcctcaagtccctgagcatctacggtttgctgtggggcaggaggtctttggtctggtgcctggtctgatgatgtatgccacaatctggctgcgggaacacaacagagtatgcgatgtgcttaaacaggagcatcctgaatggggtgatgagcagttgttccagacaagcaggctaatactgataggtaaacaagaaaatgatttatataaaaccctcttccccagggaaaattagtgtgctatctttgttatgttttgagtaaatgacaagatgtggtaaatgaaaactcacacattctatatacattaaatatgtaagcatgactgataaaatagctatcttttgatactgacaaggaagaaaacagaaatgaaggaatagcaaattttaaaaattgcattccagttgcttgaaagcttgtgatcagatgcaataaatgtttttattatttattttgtgcaaataggagagactattaagattgtgattgaagattatgtgcaacacttgagtggctatcacttcaaactgaaatttgacccagaactacttttcaacaaacaattccagtaccaaaatcgtattgctgctgaatttaacaccctctatcactggcatccccttctgcctgacacctttcaaattcatgaccagaaatacaactatcaacagtttatctacaacaactctatattgctggaacatggaattacccagtttgttgaatcattcaccaggcaaattgctggcagggtaagcattattattgaaaaccaaaacaaaagactagtcagtaactttagaatttctgccacggaaattatttttcttaaacttactaaaagagtagttagttatattgctagtaaaattattttattgatataagaagcctaactttgtttgaaaagtctaaacttttagtctagtctacagttgtcagacaaatagcaaattgtacccctaccttaaaaatattttcaaaaagtatctataatcttataggaataaatattttaggcttgaatactagtgttatttttgaaatgtaaaaaggcaaattagttctaggctggtgtcccattgaattttaagcagagctcctgttgaaatgtaggtaagcatctttccagcaaataaaaattgtctccgctgggagtttcagttttacctgatttgtacctaaggcaagctgaatacaaacagtaaatatgcctaaaattcttgttttacaactaattttactttccacaggttgctggtggtaggaatgttccacccgcagtacagaaagtatcacaggcttccattgaccagagcaggcagatgaaataccagtcttttaatgagtaccgcaaacgctttatgctgaagccctatgaatcatttgaagaacttacaggtaagaaacagtttctaaacttcttcgttttttgtttgtttgtttgtttttgttgtttttggttttcttttcgagatggagccgccctctgtcacccaggctggagtgcagtggcgccatctcggctcactgcaacctccgcctcctgggttcaagcaattctcctgcctcaacttcctgagtagctgggactacaggctcacgtcgcacgcatggataattttttgtattttcagtatagacggggtttcaccgtgttagccaggctggtctcaaactcctgacctagtgatccgccggcttcggcctcccgaagtgctgggattacaggcgtgagccaccgcgcctggcccctaaacttcttaaaagaatcaggggtcaaatggaaacagagaagttggcagcaaattgagcaaaagaatcaaactgttttttattttgtgaagtttgacattggttgtatctctgtcttcatcgccttcacaggagaaaaggaaatgtctgcagagttggaagcactctatggtgacatcgatgctgtggagctgtatcctgcccttctggtagaaaagcctcggccagatgccatctttggtgaaaccatggtagaagttggagcaccattctccttgaaaggacttatgggtaatgttatatgttctcctgcctactggaagccaagcacttttggtggagaagtgggttttcaaatcatcaacactgcctcaattcagtctctcatctgcaataacgtgaagggctgtccctttacttcattcagtgttccagatccagagctcattaaaacagtcaccatcaatgcaagttcttcccgctccggactagatgatatcaatcccacagtactactaaaagaacgttcgactgaactgtagaagtctaatgatcatatttatttatttatatgaaccatgtctattaatttaattatttaataatatttatattaaactccttatgttacttaacatcttctgtaacagaagtcagtactcctgttgcggagaaaggagtcatacttgtgaagacttttatgtcactactctaaagattttgctgttgctgttaagtttggaaaacagtttttattctgttttataaaccagagagaaatgagttttgacgtctttttacttgaatttcaacttatattataagaacgaaagtaaagatgtttgaatacttaaacactatcacaagatggcaaaatgctgaaagtttttacactgtcgatgtttccaatgcatcttccatgatgcattagaagtaactaatgtttgaaattttaaagtacttttggttatttttctgtcatcaaacaaaaacaggtatcagtgcattattaaatgaatatttaaattagacattaccagtaatttcatgtctactttttaaaatcagcaatgaaacaataatttgaaatttctaaattcatagggtagaatcacctgtaaaagcttgtttgatttcttaaagttattaaacttgtacatataccaaaaagaagctgtcttggatttaaatctgtaaaatcagatgaaattttactacaattgcttgttaaaatattttataagtgatgttcctttttcaccaagagtataaacctttttagtgtgactgttaaaacttccttttaaatcaaaatgccaaatttattaaggtggtggagccactgcagtgttatctcaaaataagaatattttgttgagatattccagaatttgtttatatggctggtaacatgtaaaatctatatcagcaaaagggtctacctttaaaataagcaataacaaagaagaaaaccaaattattgttcaaatttaggtttaaacttttgaagcaaacttttttttatccttgtgcactgcaggcctggtactcagattttgctatgaggttaatgaagtaccaagctgtgcttgaataacgatatgttttctcagattttctgttgtacagtttaatttagcagtccatatcacattgcaaaagtagcaatgacctcataaaatacctcttcaaaatgcttaaattcatttcacacattaattttatctcagtcttgaagccaattcagtaggtgcattggaatcaagcctggctacctgcatgctgttccttttcttttcttcttttagccattttgctaagagacacagtcttctcatcacttcgtttctcctattttgttttactagttttaagatcagagttcactttctttggactctgcctatattttcttacctgaacttttgcaagttttcaggtaaacctcagctcaggactgctatttagctcctcttaagaagattaaaagagaaaaaaaaaggcccttttaaaaatagtatacacttattttaagtgaaaagcagagaattttatttatagctaattttagctatctgtaaccaagatggatgcaaagaggctagtgcctcagagagaactgtacggggtttgtgactggaaaaagttacgttcccattctaattaatgccctttcttatttaaaaacaaaaccaaatgatatctaagtagttctcagcaataataataatgacgataatacttcttttccacatctcattgtcactgacatttaatggtactgtatattacttaatttattgaagattattatttatgtcttattaggacactatggttataaactgtgtttaagcctacaatcattgatttttttttgttatgtcacaatcagtatattttctttggggttacctctctgaatattatgtaaacaatccaaagaaatgattgtattaagatttgtgaataaatttttagaaatctgattggcatattgagatatttaaggttgaatgtttgtccttaggataggcctatgtgctagcccacaaagaatattgtctcattagcctgaatgtgccataagactgaccttttaaaatgttttgagggatctgtggatgcttcgttaatttgttcagccacaatttattgagaaaatattctgtgtcaagcactgtgggttttaatatttttaaatcaaacgctgattacagataatagtatttatataaataattgaaaaaaattttcttttgggaagagggagaaaatgaaataaatatcattaaagataactcaggagaatcttctttacaattttacgtttagaatgtttaaggttaagaaagaaatagtcaatatgcttgtataaaacactgttcactgttttttttaaaaaaaaaacttgatttgttattaacattgatctgctgacaaaacctgggaatttgggttgtgtatgcgaatgtttcagtgcctcagacaaatgtgtatttaacttatgtaaaagataagtctggaaataaatgtctgtttatttttgtactatttaaaaaaaaaaaaaaaaatcgatgtcgactcgagtc

SEQ ID NO: 2685 - DNA, 865 bp; single-stranded, linear
gaattccggagttccgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacggaattcc

SEQ ID NO: 2686 - DNA, 49 bp; single-stranded, linear
ttttgcagacgccaccgccgaggaaaaccgtgtactattagccatggtc

SEQ ID NO: 2687 - DNA, 851 bp; single-stranded, linear
cgggaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtcagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttaataaaaaa

SEQ ID NO: 2688 - DNA, 833 bp; single-stranded, linear
gaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctctttggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttaataaaag

SEQ ID NO: 2689 - DNA, 6711 bp; single-stranded, linear
gaattcccttgtaaggttttcttaacaaaacaccagtcacataagtgcattttattttatatttttgtttatttatttgagacggagtctcttgtctctcaggctggagtgcagtggcgccatctctgctcgctgcaacctccacctcctgggttccagcgattctcctgcctcagcctcccgagggggtagctgggactacaggtgcgcaccaccatgcccagctaattttgtatttttcgtagagatggggtttcaccatgttgtccaggctggtcttgaactcctgacctcaggtgatcctcccgcctcggcctcccaaagtgctggaattacaggcgtgatccaccgcacccggcctattttttgagagagggtcacactctgtcgtcccggctggaatgcagtgatgcgatcaccgcccactacagcctcgacctccgggctcaagcaatcctccccgcccagcctcctgagtagcgagcgcctcgacgcccagctaatttttatttttatttatttttttgtagagacggcgtctctctaagatgcccaggctggtggccggtgtcgaactcctaagatgaagcgatcctccccggccttggcctccgcgcctcctaaagcgccaggtatgagccaccgcgcctggcctacaagtgcattttaattaaagtattattaatgtctttgcctgaagaaattcgcttttaaattgtgacttatctttcacccaaaaatcaaagcacaattcagccccgaggcgggggcggtaggagctgggcggggcgggggcagggaaagaccaggagcagagattcaaaaagagtaagagggcaaaatgtgcataatgcatcttcacaggtaagagcctggccaggctcctgttttaatggcttcctcctgaagaagattcaagcagagtgtaagatattttcggaaagtagagcattttgaaagcatttcataatctctcaaaaccggagactgctcctgtcccacctcgttagagaaaacagcgatgctcaaaggcaacctccttcctgacattgcctggtaggacgcgacgtggtgtttgcccgcgcggaatgcggacgcaaggctgctcctaggtctcggggacgcgccatccccatttccgctcgcggaggcgtagggtccgggcgcgggaccccagtcgaccttgactggcggcgcgaccttgaggcctgcgttcgcctcagttgccccctctgtgcaatggggagacgcgcctcatcgcttgacaacggccgaagagccgccgcgcttccgtctcccgcgtgcgcgcgccatgctgcccacccccgttccgcactgaccctcccccgtgccccgcgtcccgtactgccgccccgccccgagtcccatgccgcagccaccgcgacggagcccgcaggcgggaacctgcctccgcgcgttagcgcgcacgcgcgcctcatgtgtcgtccccatcagcgccggcttccgtctataggccagatgcactgtcactctggcgaagtcgcagacccgattggccgggacggaggcgcgagaccgggttgcgggcggggccgaacgtggtataaaacgggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgaggtcgggcgggcggcggcgtgcgggaatggggcccagaaagtgggccggggtcggggtgggtggtagcgccccaaaggcccgggcgcggggcgaccctgcttgaggggcgagcgcgggcgggctgcggcgccatttcctgacgaggggccattttgggaggtccgcgagtcgcgggaggaggccgggacgcggcggacaaaggcaggcggggcggctgcgaggccgttgggggagggggcccgcgtccgcccgcccgcctcatgtggccgcgccctgtcctgtccgacgcacgtgctcggcggccgcgctcaggtccgcgccttgagagtcgttgtccgccctagcttggcctgggcgccgcagaccggagccagaagcacgctcgcgggggcttgcgaccgccttcctgggaagctgtcccctggcaggcatgggtgctttacatcctgagctgggaagctgtttgcttgagggtttttctcaaggatcgaggcgcggtgtgagcccgtccatgctcggtcctgtagatcccgggaggccatgttataaaaggagacttgctgggatgtgacgggttgccacttgaaatatcttccatttggataaagtaggaatatttatacatgtgccccaaacgtccctccgtgtcccccacccccaagcggaaatgtgaaaatgggccttgcctttgctggtgcccaaggaccgccttccactgcagtgacggcgctggcgggggaggcgctcttgagcccctcccgattgtccctctgcctagcaagcaagttgcgactggccacaaggcaggcctcttccgaccaaggtggattaccagtgattacctaattagttttgagagcgttaaatgagttcttaaagatcagttgtaattatagcatagtatctaaacttggcgcgtgtcttcaaagttaaatattgagtacgattccgttccagttaacatggatagaccttagggagtagcgaaataggatgttagtggttttattcctttaaatcacatctcaaaaggccaccaatggctagtttggatcttattccgaaaatagattgatcctcatgcagtcttcgtgaggacagagcgatttccttgttgcctaccctgtccatagtgcctggcacataggcactgaaacactgcatgttaatccacaccccaccccacctatgagtgtagtcaaagctggtaagtgacaagggctttcgtggaaacttggcctgacctaatgttgggcatcaggttacccaaagagcttcagggaaatgagaaaggacttgcaggtcttgatgagaatggaggggtaactgccaatgagggctttggctttagcgaaagtctgaaagggaagccataggaacttaaacgtaccgactataaagctctgagaaaagctgatgttttagaaagaccatacattctaggtacaaatacctaaaaactaaaaaataagtacgttggccaggcgggcggatcacgaagtcaggagattgagaccatcctgggcccctggtgaaaccccacctctattaaaaatacaaaaattagctgggcgtggtggcgcttgcctgtaatctcagctactctagaggctgaggcaggagatcgcttgaaccccggaggcggaggctgcagtgagccgagatcgtgccactgcactccagcctggtgacagcgagactcttgtctcaaaaaaaaaaaagtacattgctataagagaagtgcacacggatactagtagttaattcagtcacatctgtgaaatagcttataaaatgctacttttaaacaagctgtttttatgaaagggcttgtaaatgtttatggtatttaagctacctctctagccataacgtattatacattcaagaaaggttcaaaaccagatatactagaaaccaatctttattttttaccccactactaggtaagggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttgtaagttctagctcaagttggggggtggtgatagacatttaagaagccatatatcttttcagaagtaggtgtgatgtactaaaagtttgagacactttctagaagtctcactatttaagttatgactagtattggatttttggcatgtctttgggtttcatgtttcttaacccaactgcctgcagggccttatggctgtcaggagcagttcttgggaattaaagtaattactgaagaagtattctagtgagaaaatgaatttatgactcagaagcccctaaagacatgggtactaagcaacaaaataagcagatgttaattaactgtaattttctcttacagctgtttgcagacaaggtcccaaagacagcaggttggtccattttctaagtttaacaaagatgttccaattgtgacagtttgtgtgtgtgtgtgtatatatatatttttatgtatgtatatatgtgtttaatttttttttaaacagaaaattttcgtgctctgagcactggagagaaaggatttggttataagggttcctgctttcacagaattattccagggtttatgtgtcaggtacgaaatttactgaattttattttatttgggttgctcccttcatttgggattgagccagaatatttcaggatacacatatctgaactgttactctaccatttcggttctatttaacccttctattcagtttgaacttgggtttaaagtttgaaccttgcagatttggcacacttcatggttatgttgtcagaagtgacatttttcctatatgttgacagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggtaagggtacaacatggcacactaaccacctgactaaatgaaaagttgccctggggggaacggaacaaacactacttttcttcaacctttgcttccacagactttttcatccctaagatactagaagaagagcatacataaatgacaaatatagccaatgtgatacagaatgtcagatactatgatagaaacttggcccttagctgggtggttgaattaggtgctacttttttgagatggagttttgctctgttgccaggttggagtgcagtggcacaatctgggctcactgcaacctctgcctcctgggttcaagcgattctcctgccttggcctcctgagtagctgagaatacagatgtgtgccagcatgcctggctaattttttgtatttttgtggagacggggtttcatcatgttggccaagctggtcttgaactcgtgacttaaggtgaaccacctgccttggccccccaaagtgctgggatttcaggcatgagccactgcgcccaaccaattaagtgcttttttttttttttttcttttctcagactggatctcgctcttatctcccaggttggagtgcagtggtgccatctcagctcactgcaacctcctcccgggttcaagcaattcttctgcctcagcctctcaagtagctggaactacaggcatgcaccaccactcccagctaaattgtgtattattagtagagcgggatttaccatgttgtccaggctggtctcgaactcctgggctcaagtgatctgcctgccttgacccccccgaagtgctgggattacaggcatgagccactgtgcccacccaattaagtgctgcttttatgttactattaataacatgcggttggttgggttttttgtttctttggggtttttgttttgttttgtttgtttttgggggaggggggcgcaattcattctatatgtgtaactcttttttgagatggagtttcgctctgtcgcccaggctggagtgcagtggcgcgatctcggctcactgcaagctccgcctcccaggttcacgccattctcctgcctcagcctcccgagtagctgggactataggcacatgccaccatgcccggctaattttttgtatttttagtagagacagggtttcaccgtgttagccaggatggtctcgatctcctgacctcgtgatccgcccgccttggcctcccaaagtgctgggattacaggcgtgagccaccgcacccggcctatatgtgtaactctttaatggtaattggagaatcatgtttaatgacatttagtacaaaaggcttcagttaaaaaaaaaaaaaaaaagctacctttctcgtcttggttcatgacacatggaggctgcttgtttgtggttgccagtcataatgattgttcttccttttcaaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatatt

SEQ ID NO: 2690 - DNA, 723 bp; single-stranded, linear
gtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtc

SEQ ID NO: 2691 - DNA, 10032 bp; single-stranded, linear
gaattccggagttccgggcgcgcgcgacgtcagtttgagttctgtgttctccccgcccgtgtcccgcccgacccgcgcccgcgatgctggcgctgcgctgcggctcccgctggctcggcctgctctccgtcccgcgctccgtgccgctgcgcctccccgcggcccgcgcctgcagcaagggctccggcgacccgtcctcttcctcctcctccgggaacccgctcgtgtacctggacgtggacgccaacgggaagccgctcggccgcgtggtgctggagctgaaggcagatgtcgtcccaaagacagctgagaacttcagagccctgtgcactggtgagaagggcttcggctacaaaggctccaccttccacagggtgatcccttccttcatgtgccaggcgggcgacttcaccaaccacaatggcacaggcgggaagtccatctacggaagccgctttcctgacgagaactttacactgaagcacgtggggccaggtgtcctgtccatggctaatgctggtcctaacaccaacggctcccagttcttcatctgcaccataaagacagactggttggatggcaagcatgttgtgttcggtcacgtcaaagagggcatggacgtcgtgaagaaaatagaatctttcggctctaagagtgggaggacatccaagaagattgtcatcacagactgtggccagttgagctaatctgtggccagggtgctggcatggtggcagctgcaaatgtccatgcacccaggtggccgcgttgggctgtcagccaaggtgcctgaaacgatacgtgtgcccactccactgtcacagtgtgcctgaggaaggctgctagggatgttagacggaattccttttgcagacgccaccgccgaggaaaaccgtgtactattagccatggtccgggaacgcaacatgaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctcttcggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtcagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggttttttttttttttaataaaaaagaaggtgctccttgccgccgccctcatcgcggggtccgtcttcttcctgctgctgccgggaccttctgcggccgatgagaagaagaaggggcccaaagtcaccgtcaaggtgtattttgacctacgaattggagatgaagatgtaggccgggtgatctttggtctctttggaaagactgttccaaaaacagtggataattttgtggccttagctacaggagagaaaggatttggctacaaaaacagcaaattccatcgtgtaatcaaggacttcatgatccagggcggagacttcaccaggggagatggcacaggaggaaagagcatctacggtgagcgcttccccgatgagaacttcaaactgaagcactacgggcctggctgggtgagcatggccaacgcaggcaaagacaccaacggctcccagttcttcatcacgacagtcaagacagcctggctagatggcaagcatgtggtgtttggcaaagttctagagggcatggaggtggtgcggaaggtggagagcaccaagacagacagccgggataaacccctgaaggatgtgatcatcgcagactgcggcaagatcgaggtggagaagccctttgccatcgccaaggagtagggcacagggacatctttctttgagtgaccgtctgtgcaggccctgtagtccgccacagggctctgagctgcactggccccggtgctggcatctggtggagcggacccactcccctcacattccacaggcccatggactcacttttgtaacaaactcctaccaacactgaccaataaaaaaaaatgtgggtttttttttttaataaaaggaattcccttgtaaggttttcttaacaaaacaccagtcacataagtgcattttattttatatttttgtttatttatttgagacggagtctcttgtctctcaggctggagtgcagtggcgccatctctgctcgctgcaacctccacctcctgggttccagcgattctcctgcctcagcctcccgagggggtagctgggactacaggtgcgcaccaccatgcccagctaattttgtatttttcgtagagatggggtttcaccatgttgtccaggctggtcttgaactcctgacctcaggtgatcctcccgcctcggcctcccaaagtgctggaattacaggcgtgatccaccgcacccggcctattttttgagagagggtcacactctgtcgtcccggctggaatgcagtgatgcgatcaccgcccactacagcctcgacctccgggctcaagcaatcctccccgcccagcctcctgagtagcgagcgcctcgacgcccagctaatttttatttttatttatttttttgtagagacggcgtctctctaagatgcccaggctggtggccggtgtcgaactcctaagatgaagcgatcctccccggccttggcctccgcgcctcctaaagcgccaggtatgagccaccgcgcctggcctacaagtgcattttaattaaagtattattaatgtctttgcctgaagaaattcgcttttaaattgtgacttatctttcacccaaaaatcaaagcacaattcagccccgaggcgggggcggtaggagctgggcggggcgggggcagggaaagaccaggagcagagattcaaaaagagtaagagggcaaaatgtgcataatgcatcttcacaggtaagagcctggccaggctcctgttttaatggcttcctcctgaagaagattcaagcagagtgtaagatattttcggaaagtagagcattttgaaagcatttcataatctctcaaaaccggagactgctcctgtcccacctcgttagagaaaacagcgatgctcaaaggcaacctccttcctgacattgcctggtaggacgcgacgtggtgtttgcccgcgcggaatgcggacgcaaggctgctcctaggtctcggggacgcgccatccccatttccgctcgcggaggcgtagggtccgggcgcgggaccccagtcgaccttgactggcggcgcgaccttgaggcctgcgttcgcctcagttgccccctctgtgcaatggggagacgcgcctcatcgcttgacaacggccgaagagccgccgcgcttccgtctcccgcgtgcgcgcgccatgctgcccacccccgttccgcactgaccctcccccgtgccccgcgtcccgtactgccgccccgccccgagtcccatgccgcagccaccgcgacggagcccgcaggcgggaacctgcctccgcgcgttagcgcgcacgcgcgcctcatgtgtcgtccccatcagcgccggcttccgtctataggccagatgcactgtcactctggcgaagtcgcagacccgattggccgggacggaggcgcgagaccgggttgcgggcggggccgaacgtggtataaaacgggcgggaggccaggctcgtgccgttttgcagacgccaccgccgaggaaaaccgtgtactattagccatggtcaaccccaccgtgttcttcgacattgccgtcgacggcgagcccttgggccgcgtctcctttgaggtcgggcgggcggcggcgtgcgggaatggggcccagaaagtgggccggggtcggggtgggtggtagcgccccaaaggcccgggcgcggggcgaccctgcttgaggggcgagcgcgggcgggctgcggcgccatttcctgacgaggggccattttgggaggtccgcgagtcgcgggaggaggccgggacgcggcggacaaaggcaggcggggcggctgcgaggccgttgggggagggggcccgcgtccgcccgcccgcctcatgtggccgcgccctgtcctgtccgacgcacgtgctcggcggccgcgctcaggtccgcgccttgagagtcgttgtccgccctagcttggcctgggcgccgcagaccggagccagaagcacgctcgcgggggcttgcgaccgccttcctgggaagctgtcccctggcaggcatgggtgctttacatcctgagctgggaagctgtttgcttgagggtttttctcaaggatcgaggcgcggtgtgagcccgtccatgctcggtcctgtagatcccgggaggccatgttataaaaggagacttgctgggatgtgacgggttgccacttgaaatatcttccatttggataaagtaggaatatttatacatgtgccccaaacgtccctccgtgtcccccacccccaagcggaaatgtgaaaatgggccttgcctttgctggtgcccaaggaccgccttccactgcagtgacggcgctggcgggggaggcgctcttgagcccctcccgattgtccctctgcctagcaagcaagttgcgactggccacaaggcaggcctcttccgaccaaggtggattaccagtgattacctaattagttttgagagcgttaaatgagttcttaaagatcagttgtaattatagcatagtatctaaacttggcgcgtgtcttcaaagttaaatattgagtacgattccgttccagttaacatggatagaccttagggagtagcgaaataggatgttagtggttttattcctttaaatcacatctcaaaaggccaccaatggctagtttggatcttattccgaaaatagattgatcctcatgcagtcttcgtgaggacagagcgatttccttgttgcctaccctgtccatagtgcctggcacataggcactgaaacactgcatgttaatccacaccccaccccacctatgagtgtagtcaaagctggtaagtgacaagggctttcgtggaaacttggcctgacctaatgttgggcatcaggttacccaaagagcttcagggaaatgagaaaggacttgcaggtcttgatgagaatggaggggtaactgccaatgagggctttggctttagcgaaagtctgaaagggaagccataggaacttaaacgtaccgactataaagctctgagaaaagctgatgttttagaaagaccatacattctaggtacaaatacctaaaaactaaaaaataagtacgttggccaggcgggcggatcacgaagtcaggagattgagaccatcctgggcccctggtgaaaccccacctctattaaaaatacaaaaattagctgggcgtggtggcgcttgcctgtaatctcagctactctagaggctgaggcaggagatcgcttgaaccccggaggcggaggctgcagtgagccgagatcgtgccactgcactccagcctggtgacagcgagactcttgtctcaaaaaaaaaaaagtacattgctataagagaagtgcacacggatactagtagttaattcagtcacatctgtgaaatagcttataaaatgctacttttaaacaagctgtttttatgaaagggcttgtaaatgtttatggtatttaagctacctctctagccataacgtattatacattcaagaaaggttcaaaaccagatatactagaaaccaatctttattttttaccccactactaggtaagggcctggataccaagaagtgactgctcatctaatccataaagctatgttaacagattggaggtagtagcattttcattacaagtgactaaaagaacagctgtttacccctgatcgtgcagcagtgcttgctgttccttagaattttgccttgtaagttctagctcaagttggggggtggtgatagacatttaagaagccatatatcttttcagaagtaggtgtgatgtactaaaagtttgagacactttctagaagtctcactatttaagttatgactagtattggatttttggcatgtctttgggtttcatgtttcttaacccaactgcctgcagggccttatggctgtcaggagcagttcttgggaattaaagtaattactgaagaagtattctagtgagaaaatgaatttatgactcagaagcccctaaagacatgggtactaagcaacaaaataagcagatgttaattaactgtaattttctcttacagctgtttgcagacaaggtcccaaagacagcaggttggtccattttctaagtttaacaaagatgttccaattgtgacagtttgtgtgtgtgtgtgtatatatatatttttatgtatgtatatatgtgtttaatttttttttaaacagaaaattttcgtgctctgagcactggagagaaaggatttggttataagggttcctgctttcacagaattattccagggtttatgtgtcaggtacgaaatttactgaattttattttatttgggttgctcccttcatttgggattgagccagaatatttcaggatacacatatctgaactgttactctaccatttcggttctatttaacccttctattcagtttgaacttgggtttaaagtttgaaccttgcagatttggcacacttcatggttatgttgtcagaagtgacatttttcctatatgttgacagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggtaagggtacaacatggcacactaaccacctgactaaatgaaaagttgccctggggggaacggaacaaacactacttttcttcaacctttgcttccacagactttttcatccctaagatactagaagaagagcatacataaatgacaaatatagccaatgtgatacagaatgtcagatactatgatagaaacttggcccttagctgggtggttgaattaggtgctacttttttgagatggagttttgctctgttgccaggttggagtgcagtggcacaatctgggctcactgcaacctctgcctcctgggttcaagcgattctcctgccttggcctcctgagtagctgagaatacagatgtgtgccagcatgcctggctaattttttgtatttttgtggagacggggtttcatcatgttggccaagctggtcttgaactcgtgacttaaggtgaaccacctgccttggccccccaaagtgctgggatttcaggcatgagccactgcgcccaaccaattaagtgcttttttttttttttttcttttctcagactggatctcgctcttatctcccaggttggagtgcagtggtgccatctcagctcactgcaacctcctcccgggttcaagcaattcttctgcctcagcctctcaagtagctggaactacaggcatgcaccaccactcccagctaaattgtgtattattagtagagcgggatttaccatgttgtccaggctggtctcgaactcctgggctcaagtgatctgcctgccttgacccccccgaagtgctgggattacaggcatgagccactgtgcccacccaattaagtgctgcttttatgttactattaataacatgcggttggttgggttttttgtttctttggggtttttgttttgttttgtttgtttttgggggaggggggcgcaattcattctatatgtgtaactcttttttgagatggagtttcgctctgtcgcccaggctggagtgcagtggcgcgatctcggctcactgcaagctccgcctcccaggttcacgccattctcctgcctcagcctcccgagtagctgggactataggcacatgccaccatgcccggctaattttttgtatttttagtagagacagggtttcaccgtgttagccaggatggtctcgatctcctgacctcgtgatccgcccgccttggcctcccaaagtgctgggattacaggcgtgagccaccgcacccggcctatatgtgtaactctttaatggtaattggagaatcatgtttaatgacatttagtacaaaaggcttcagttaaaaaaaaaaaaaaaaagctacctttctcgtcttggttcatgacacatggaggctgcttgtttgtggttgccagtcataatgattgttcttccttttcaaggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtcctcgtttgagttaagtgttgatgtaggctttattttaagcagtaatgggttacttctgaaacatcacttgtttgcttaattctacacagtacttagattttttttactttccagtcccaggaagtgtcaatgtttgttgagtggaatattgtgtactattagccatggtcaaccccaccgtgttcttcgacattgccgtcgacggcgagcccttgggccgcgtctcctttgagctgtttgcagacaaggtcccaaagacagcagaaaattttcgtgctctgagcactggagagaaaggatttggttataagggttcctgctttcacagaattattccagggtttatgtgtcagggtggtgacttcacacgccataatggcactggtggcaagtccatctatggggagaaatttgaagatgagaacttcatcctaaagcatacgggtcctggcatcttgtccatggcaaatgctggacccaacacaaatggttcccagtttttcatctgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtagctcaggagagcacccctccaccccatttgctcgcagtatcctagaatctttgtgctctcgctgcagttccctttgggttccatgttttccttgttccctcccatgcctagctggattgcagagttaagtttatgattatgaaataaaaactaaataacaattgtc

SEQ ID NO: 2692 - DNA, 56583 bp; single-stranded, linear
gatctgtctagggctgtcagtggagtattgaagtcccccacgattattgtgttactgtctatctcatttcttaggtctattaataacaggtttttttgttttgttttgttttgttttgtttttttgagatggagttttgctcttgttgcccaggctggagtgcaatggcatgatctcagctcactgcaacctccgcctcctgggttcaagcgattctcctgcctcagcctcccgagcagctgggactacaggcatgcaccaccacacctggctaattttgtatttttagtagagacaagggttctccatgttggtcaggctggtcttgaactcccgacctctggtgatcttcccacctcagcctcccaaagcgctgggattacaggcatgagccaccgtgcccggcccatagtaactgttttataaatttgggagctccagtgtttagtacatatatgtttagaattgtgatatttccctgttggacaaggccttttaccattatataatgccctcttttgtctcttttagctgctgttgctttaaaatttgttttgtctgatataagaatagctacctctgctcacttttggtgtctatgtgcatgaaatgcctttctccacccctttactttatgtgagtccttatgtgttgttaggccagcatcaccctaatatcaaaaccagcaaaggacataccaaaaaagaacattacagaccaatatttttgatgaacacagatgctaaaatcctcaacaaaatactagctaaccagttgcaacaacataccaaaaagataatccaccatgatcaagtaagtttcgtaccagggatgcagaaaagcagcagatggtttgtgagttcttatctattctgcaattctgtagaaaagtggagcatttaggccatttacattcaatgttagtattgaaatttgaggtaccattgcattcatcatgctctttgttgcctgcgtactttggtttgttttttgattttgctctttaacttgtatttttgttttataggtcctgtgtgatttatgctttaaagagattctgttttgatgtgtttccaggatttctttcaagatttagagctcctttaaacagttcttgtagcagtgccttggtaatggcaaattctctcagtatttgtttgtctgaaaacgactgtatctttccttcatatgtgatgcttagtttcactggatgcaaaattcttgactgataattgttttgtttgaggaggctgaagatagggccccaaccccttctagcttgtagggtctctgctgagaaatctgctattaatctgataggttttccttataggttacctggtgcttctgtctcacagctcttaagattctttccttggtcttaactttgtataacctgacgacaatgtgcctaggtgaatatctttttgtatccatcgcccaggctggagtgcagtggcgcaattttggctcactgcaacctctgcctcccaggttcaagcaattctcctgcctcagcctcccaaggagctgggattacaggctcctgccaccacacccagctaattttttttttttgtatttttagtagagacagggttttgccatgttggccagcctggtctcaaactcctgacctcaggtgatccacctgcctcggcctcccaaagtgctaggattacaggcgtgagcccccgcacccgagccctgatattaatttttaaattaaaagactttatttttaaaagcagtttgaggtttacagaaaaactgagcagaaagtacagtctctatataccccctactccctgcccccagttttccctgttattaacatttgtgttaatgtggcatatttgttacaatcagtgaatcaatattgataaattaaagtccatatgttagtgttcactctgtgtgttatacagttctatgggttttgccaaatgtattaatatgtcatgtatccatcattacagtatcatccagcataatttcactgtcctgaaaatgccctgtgctccacttattcatcttttccccacttgctatcaccacaccaaagccctcacaaccacttatctttttaatatatccatagttttgccttttgcagaacatcatatcattagaatcacaataatatgtggcttttcagactggtttctttcactcagcaacatgcagttaagggtcttccgggtcttttgtggcttgacagctcatttctttttatcactgaataatattgcattgtatagatataccacagttttttttaaatttactcatcattaaaggacatcttgattacttctaatttctggcaataatgaataaagttgatacaaaaacttttgtgtaggattttgtgtggacatatgttttcaactcattgaggtaaatgcctaaggcatatttagttttgtaagaaactgctaaactatcttccaaagtatctgtaccattttgcattcccaccagctatgaaagagtttctgttctacatcttcacaaacattggtgttatcagtgttttggattttagccattctaattggtgtggagtggtatctcattgttgttttaattttgcaattccctaatgacatatatgttgagcatcttttcatatgcatatttaccatctgtatatcttctttgggcatatgtccattcagatcttttgcacatcttttcattgggttgctcattttcttattgagttttaagagttcttcatatatttttgataacagtcctttatcagatatgtcttctgcaaatattttctcccagtctttgtcgtgtcttttcatttacttaacagtgtctttcataaaacagaaggttttaactttgatgaagtctaacttgccaattttttctttcatggattgtgctttgtgtgttgtatctaaaaactcattgccaaacacaaggtcacctctatgttctcctatgttatcttctagaagctttgtagttttctgttttacatttataggggctgtgagaaggtgacagaggttacatgaggtaataaggatagggccttagttgaataaggctagtgcccttataagaggaagagacgccagttttctctctctctaccatacgaagacacagcaagaaagtggccatctacaagtcaagaagtgggccatcaccagaaaccaaattactggcaccttgatcttaaacttcccagcttccaaaactgtgagaaataaatttctgctgtttaagccatgcaacctacagtataagttatagcagcccaagcagactaagacagaacccttagcatattaatcatagttactttaaatctctggtcccataattccaaaatatctgccacatctgagtctggttctagtgcttgctttgtttcttcaagactgtggttttttttctctttttagcatatcttataatttttctgttcaaagcaaggcatgatgtactgggtaaagggaactgaactgaggtagataggtgtttagaatgaaatttagaggcaacttaagaaagtactcaaaaaacaaaattatgggagcatgctaaatggacacaggagccagcctgaaagagcttgcaatggacaaagttggaacaatttgagcaacaaaataagttattcttccttatagaggaattctaaataatttatatagatacttgccttccaggaagtggcacttaatccccatcaaaccctcataagtgtgggctggacttggtaacttccttccaaaaaatagagtatggaaaaggggtgaagtaacttcatagtggaaaaacctggcaaacactaccttggttagctgagcaaagccttgatatggtgtgatgagaatggaatattacctttgtgatctttctctcaaacacttataatcccattctaatcatgaggaaagcgtaagacaaatcccaattgagggacattctacaaaatacctgaggagtactcctcaataggtcatcaaaacaagtcttagaaactgtcacagtcaagaagaaactaaggaaaaatgacaactaaatgcaatgtggtatcatggactggctcctagaacagaaaaagtcagtatataaaaactaagaaaatctgaataaagtatggactttagtgataataatgtatcaatattggtttattacttgtagcaaatgtaccatactaatctaagatgataataaaaacaataactctgtgtagggccaaagggagggaagtgggctgatacgggaactctccgcactatcttagcaactttttggcaaatctaaaattactccaagatactaagcttcttttttaaaaaaaatcacaaaacctgaaaaattttaaagaaataaaaatttaaaaattaaaaagagtcaaatcccagctgtatttttattaattatgtaatattgtacaagtcactctctgagctttggtgtccctgtttataaaagtgatagaatacatttttgagtgacatctgaaagatagcagagtaggaagctccaggccctcctttccccatgtaatctgtgaaaggaaattcaatttcgggacgccaaactcatttagcgaaagggaaaagtcaaagtgggaactgggtcatgcaaacctgcctcccacttttgggtcctcaataagatggctacaagatgaaaagctacatgcctccgccatattttgcccacaaggaaattcctagtgagttgttaaaatttcaccgtagcaatgcaaattgatagcttatctttacaggtgcagtcgcccccggcgcactagacataaatgcacatctgagtgttcccctgccccattttgtccatgttatcttatgtaaaatgcatattccccacatttttcctctgcctcttttatgtcatcttattaatgcagattccctgagccagacaaaggcatgaatgactatttttccctaccctcctcttacatgaaaattgtgtacttctcagtatcgcaccctttcccctttaaattttgagccctcaaaatcatcttcggagacaggcatagacctgtctcctgagtgcatccttaactttggcaaataaatcccctaaaatgattgagacttgtcatttttctcaattgacatctggtaaccacgaagggatcctgagtgaaagtgacccagcctgcagtagctcacctctcagtgcttggcaccggcttggtcaccttatagcccaaactgagaggacaatttgccaaagtcgaggacctctttccagggatctctgatcttccaacattttccagttgggggtctgaagtttatttgctgttaaaaacaaaacaaaacaacaaaaacaacaaaaattcctttttttgtaggcgtttccactcacttccatcaaggaaggcgagcctgtctgcttctgcatatgcagagagcaatcttcagcttgggcccccatcactaggtaagaaactggtttggaattctgtcttgcaaattcttttaaacgactagaattagcactaacaaccagctggtgttaatttcctgcttacccttagagcgctcagaaatcatataatttgcgtgatcattgttagttttgtttaattgttttgtttctgggtttgtgtgtgtgtgtgtgtgtgtgtatatatatctgtgtgtgtgtgtgtgtgtgtgtgtgtgtgtgtgtgtatgtgtgtgtgtgtgtgttttggtcctttcccctatcggatttgaccaattctgaaccttcaagctcatgagtgtgaaattttccactctgaagaaacagaacacattgctcccctcagccctttggggcattctcaggcgactgagaatcacatgagggtttctgggagaaatgctccctaagacatgcagcagctctaaataggtttccccctcaaaagaacatacttagggtctaatctcagccagcagatgcatataaggaactgacccctcccaaactttgagcccctgacacactgtgccaggtggccacaacgctggtggaccaaactggttcagggtgtaatggccctgtgaaaagctaggtttgcaagcagcacattttgggtccaacacacatcccaacttggtcaaatccaaaggggaactctaaattatagagaacaaggcctctaagaccccagcagttgcagaatataaagttcccctcttagaaactccagcagggtatatgcaaaatacttatggtgaatcatcatgcaaatatttaaccaagcggaccactataactaaagcagattctaagttacaatggcctaaatggggatcttttgagatgcccaaattagtgtacctgtgaaccaggatggagaatgcagacacaaaaaccaaacaaccagaatgggacagctattttcagtggtagctgcaaagtagcaaaagtggggaagaccactgtcacgcgtgtctgggtgaagtgaccaccaaacaggctttgtgtgtgcaacaaggctgtttatttcacctgggtgcaggtgggctgagtccgaaaaagatgtcagcaaagggagttaggggtggggcagttttataggatttgagtaggtagtgtcaggaggcccgacactcctgtcttcttatattaataagaaaaacaaaacaagatagtggcgaagtgttggggtggcaaaaattttggggggtggtatagagagataatgggcaatgtttctcagggctgcttcgagcaggattaggggcagcgtgggaacctagagtgggagagattaagctgaaggaagattttgtggtaaggggtgatattgtggggttgttagaagcaatatttgttgtacagaatgattggtgatggcctggatacagttttgtatgaattgagaaactaaacagaagacacaaggtccgaataagagaaggagaaaaacaggtattaaaggactaagaattgggaggacccaggacatctaattagagtgcctaagggggttcagcgtgattattgcttggttggtcagttttggggctctatccttgagtttttttatgttgtcacataccaggccagattgatttaggtgaaaacaacactcttcatttaaaaatatagagtcccctttttttaagcagtgagtaagcggaagtctcggtgattttggaggaaatagaaatgcaaagccagcaattgtttgttaaagaaggattagaaacggctaggagagagtgagattgatagtgtggtggagatagctggggagaggtagagggtggcataagaatgggaacgagaataagagtgagtaaaaaagtaaagaataggacttcatcagggtgaaagtaccggactgtgccttgccactgaagatcttttatccacttcaagagagatttaagggtggtggtttgagataaaaccaggagataccagttatgatggtttggaggaaaagtgtaaactgggagtgtaaacaagggcagggcatttatgagtagttgagaatggtgaataggagtatgactagacagaagatagtagggatgacaagtttttggggtgcagtccaagttgggctggtgtctggaatgagactggggcctaataaaaaggagtgtccatacaggagctcaaatgggctgtaccctgtagcatcccgaggacaggcccaaattctgagaagggcaagtggtaaaagtattgtccagtcctttttaagttggaggctgagcttggtgaggtgtgtttttaaaagaccattagtccattttacctttcctgaagattgaggatgggaaggggtatgaaggttccactgaataccaggagcctgagaaactgcttgggtgatttgactaataaaggccggtccgttatcagactgtatagaggtgggaaggccaaaccgaggaattgtgtctgacagaagggaagaaatgaccacagtggacttctcagaccctgtgggaaatgtctctacccatccagtgaaagtgtctacccagaccaagaggtattttagtttcctgactcagggcatgtgagtaaagtcaatttgccagtcctgggcaggggcaaatccctgagcttgatgtgtagggaagggagggggcctgaacaatccctgagaagtagtagaatagcagatggaacactgagaagtgatttccttgaggatagagttccacgatagaaaggaaatgagaggttctaagaggcgggctagcagcttgtaacctacatggaagaagttatgaaatgatgacagaatagaatgggcctgtaaggctggaagcaaatattttccttggtccaagaaccatttgccttgtgtgggaagagattgataggtggaagtttcagcgggggagtaggtgggagtgaccaatgaaaaggagaaaaactggcagtgagggacagaagttggaatgctagctgcttttttagttatcttattagcataagtgttgccttgagcgatgggatctgatgccttttgatggcccttgcagtgaatgactagcttttttggaagtagagcagctttaagaagagtttttattaaggaggcattaattatggaggacctttgtgtagtggggaaacttttttctgctcatataacagcatggtagtgcaggatatggaaggcatatttaaagtcagtataaatattaacacatagtccctttgcaagagtgagggcctgagttaaggcaatgagtttggcttgctgagaggtagtggaggggggcagagcagtagcctcaaggatagatgtggaagacactatagcttagcctgcctttgccagtgattggcgattaggcctggtggaactgccatcaagtgtgatcagggtgaagaacaggaaagaaggaaatatggggaaatggagtgaatgccaggtggatcagagagatacagtcatgggggtcagatgtggtatcaggaataatgtgggaggccggattgaagtccaggccaggaacaacggtaactgtgggagactcaagaaagagtaagtacagctgaaggagccagggggcaggaagtgtgaggaggaaaatagattttgaaagttatgggaactgtagagggttagtggagcatagcttgtgatttttagggcctctaaaagtattaaagcggcagcaatgaggtgtggctgtagcctaggaatagtcagggaagcggataatttagttaaaatgtctcaatctaataagggagctgggcaggtggggataactaaaaaagagtgcataaaagaatgttgtccaagttggcaccagagttggggagttttaaggggtttagaagccttgctgtcaatacccacaacagttatggaggcaagggaaacagtcccttaaaaagaaggtaatgtggagtgggtagcctccatattgattaagaaggggacggacttaccctccactgtaagagttacccaaagtgtctgtgatggtccaggaggtttccgaggcgattaggcaatgtcagtcttcaactgctaagccacgaatatctgggaaggagtcagtcagagagccttgggccagagttccaggggatctgggagtggctgccaggcgagttggacagtccaatttccagtggggtcccgcacagatgggacatggcttaggaggaatcccgggctgcgggcattccttggcccagtggccagatttccggcacttgaagcaagatcctgggggtggcagtcctggaggaacgcctggctgctgcagttcaggtgttttgaagttcttgtgtgctggagatgtggctggggtttctctcacagtggaggcaagtaattgcaactcagaaatacgttgctacttggctgcctctactccattattgtccacattgaaggagaggttaattaagtcctgttgtggggtttgagggccggaatctaatttttggagctttttctaatgtcaggagcaggttgggtaataaaatgcatattgagaataagatggctttctggcccttctgggtctagggcagtaaagcatctaagggttgttgccaaacgggacatgaactaggctggatttttatatttgatgaaaaagagcctaaccactaactgatttgggagaggtcagataaagaaaaaggagaattaaccttggctatgccttcagctccagccacctctttaagaggaaattgttgggcaggtcggggagggctagtcacagaacaaaactataagctggaccaggtgtgaggaggggaggtgataaaaggattatagggtgggagagcagaggctgaggaagaattgggacctggctcggcgtggcaaggagcagcctggggaggaggggagaggtcagataggtccgtagaaaaggaggattcaaaggactcagagcttgggatggagactgaaggaacaggagagaaagaagaaagatttgggacaagtcgcactgggagcagagactaaggagggatcaatgtgtaaaagaatgcctggacgtcaggcacctcagacccatttgcccattttttgaccaaaatcatccaggtcttgtaaaatggagaaatcaaaagtgccgttttctggctatttagaaccattattgagtttgtattggggccaagcagtgttgcagaagaaaataagacgcttaggttttaggtcaggcgagagttgaagaggttttaagtttttgagaacacaggctaagggataagaagagggaatggagggtggaaggttgcccatagtgaagaaggcaagccccgagaaaatagagggtagagacatggagaaggggggtggtgagcagccctgggctgcaatgtgggcgagcagccacagccaaagcaggcgtccctgcaattgacttgccaccaagggaatgtgggtgaatgaccaaggtaggcatccctgcggtgatcagacaccaatggagtgtgggtgaataatcaggcaggtgtccccgcagtgattaaacaccaagggaagactgtcttcctgagttcatgactggcgccggagttctgggtccatggataaaatgtgtctcctttgtctctactagagaggaaaaagaactagaattggaaggacagagagattgaagggtagcgagagagggagactgaagggtggcaagagaggctggagaagagagtaaaaagaccacttacccgatttgaaattggtgagatgttccttgggctggttggtctgaggacccgaggtcataggtggatctcctcatggagtgagggcgaggacaggggactggtctcccaaaggagtcctcctgtcccgggtcttcggcaccaaatgtcacactcgtccgtgtgaagagaccaccaaacaggctttgtgtgagcaacaaggctgtttatttcacctgggcgcagttgggctgagtccgaaaaaggagtcagcaaagggagttaggggtggggcagttttataggatttaggtaggtagtggaaaattacagtcaaagggggttgttctcttgcgggcaggggctggggtcacaaggtgctcggtgggggagcttctgagctaggacatttcacaaggtaatgtaatcagttaaggcaggaacaggccattttcacttcttttgtgattcttcagttgcttcaggccatctggatatatacgtgcaggcttgggctcagaggcctgacaaccacctcatctccctacaggaggccaacaaacaacttagaaatgctaaccaagaactctgtaatcttgtatctctcttaaagaaatcctcagaattccttacttcccccttggtacctccccctacacccctactctaccctgaccaatctgaacttcctggaccagatctgtccgccgcctctactgcatgtctaacacttgctcaacagaaggcagttcagagtctgactgcaaagaccccaccccctcatgattccctgacagctccaatggcaacatctcatctggaagatgtggaaaagggggaccgtgcagggatatctctcatgatcaccctattttgggaacaactgctaacaggtaggggaaccctggtaattgtctaccaacaccctggtcaaaggctgaattccaaggcataaagaatttcctgacccccataaagatccaattgggtttgagtatttgagctcattgtcagaacctatgacccaggtcattcagacttttatcagctagtccacatgttggtctcagaagctaaagctaaggaatggctgggaaaagcacaatggtcagactctatagcagatttgacccctgaaggcccaatggagccacaacaaccagcccccacaaatccagaagacaggcacaaagatgtgcaggaatgagcaaccactctattaaatatcattccttcagtgttccaaagggttgtggattggaataaaatccaacaatgtcaccagaacccaaataaattagttttagattatttaacacattttgataaaactttaaaacaacattgtgggatgtcagctgattgctttgaaaacaataaaaatgatacattattaaatgcaaatttcttaaacggactagatgatgatttagccacccttgtaaaacacaaattggaccacagccagaactaatgaactagttaacttagctgaccaattatcccgcactatgataaaacaaggaaaaacagaagattgcccaagttatgcatttacagctaaagcaattaacttctcaagcctctcggccccagaaagattttaagctccctcggtctgaggactcttccctcccagtctgttacaactgtaaatgaccgagacaccttatgatggattgccttaggctgaaacaaaagaaaaggcagaatgcaactcaggaagacaaggggtgctccaaggaaatacaggggtttcacctctccaaatattctaccctgacaaaccaattgggggagattaatataataataaaccatgagtttacaactgccttaactgacataggtgtgactatctctgaaaaatcccaccttatttagaaaccccattcctcagagtaatgaaagaatgaacatggtgggtatgtctaataaaatgatctcatgttttaagtccaaacccgtaccttagggttcatcaggttccactaccctgtcgcaggctctaagtgtgacacactcagtaggtcccatatgtttctaatatgcactggggcccctgtcaaacttttgggctgtgatctcaacatccataatgcccatatctctttttcatcaaaaggtgaaacttttttagaattggagccaggagaccaaaaataccatatttaaaaatgtcctgacaacgtacaatttagtactagtaatgttaaaatgtcatcttgtgaccaggaaaataaaatagagacagagaaggaaatattagggaagaagagagaacattggaatacagagcaggaaacagtaaaactccttttagtttccccagtcttcctgttaacaccagaagcagagcacttgctcaaggatgtgtcctcccacttatagtctcagtcaaatacagatacagagaaagtattctcagccattccaataaaggtagagataaatccaaagaaacccctatccaaccttaaacactatcctctgcaaaaggaagccatagatggaattgctcctgtcatacaagattatctgagaaacgggctcattattccctgcacaatcccctgaaacagccctatattccctgtaaagaaactaagcgggagaggatggaaatttgtgcaggaattgagggcaataaacaatatcataattctcaggcacacagtagtccccaacccacaaacccttctatcacctatatccactaccagccagtatttctcagttgtggatctctgcagtgccttctttagtattcctgtagaaccagacagccaatatttgtttgtctttatttggaaagaatggcaatatacgtggactataatgccccaaaggtatacagaaagtcccacttagtgttcccaaatattagaagctgatttggagaattaaatattttcccagggctcaacattcatctactctcctttgttcagacacactctcttcctctcaggaagatagtctatatttactcaaacagccaccaagggacacaaatgtctaaagacaaacttcagctatgcttacctgaagttaagtatttgggacatattatctcagccaaaggactgagtattaaccctgatagagtgaggaattttagctttcccaatgcccgtcactaagaaacaacttagagtattttggggcctggcaggctattgtagaaactggataccaaatttctcccttatggctcaacttcagtgtacatacctaaaaaatgaacaacctgatcccatcatgtggactccggagggacaatcagctgtacaacaaataaaggaaattctgactaatgccccagccttagggcacccgaactacaaattgcctttctcccttttcatacacgaagttggaggtactgcatccggagtactgacccagaaacatggtgatcatcagagacctataggctattatagccaacagctggaccctgtggctcaagggctgcctccctatgtgagagcaatagcagccacggcccttccgtataagtctgttgaagaaataattataggttccccccttaacatttttgtgccacattctcttgagacccttctaaactctcatcatacacaacacctgtctgtcaactggttagcctcttatgaaattttgcttttatcatctcccaatattactagttcctgctgtaataatcttaatctggccactctcttgccaggcccttctgacaaaaccccctcatgactgtgttttgatgactgacttctcacccccaggacagacctacaagagatgccactggataatgctgagatagaatggtatacagatggatcttatttaagaggagaggatggaaattttatagcaggatatgctgtggtttccttactagaggtaattgaagccaatcctctcccccaagccagatcagctcaagtgaccaaattggttgccctgaccgaagcttgtcaattggcaaaagacaaggctgcaaacatttacactgacagccactatgcttttggggttgctcatgactgggatgttatggaaagagagaggatatttaaccccctcagggcaacccataaaaaatggacaagtatcagagttgttagaagctgttctaacaccaaaacgcttggcaattataaaaatcccaggttggccaggcgcagtggctcacgcctgtaatcccagcactttgggaggccgaggcaggaggatcacgaggtcaggagatcgagaccatcctggctaacatggcgaaaccccgtctctactaaaaatacaaaccccgtctctactaaaaatacaaaaagttagccgggcgtggtggtgggcgcttgtagtcccagctactcgggaggctgaggcaggagaatggcatgaacctgggaggcagagcttgcagtgagccgagatggcgccactgcactccagcctgggcaacagagagagactccgtctcaaaaataaataaataaaattaaaaaaaaatcccaggtcactcaaaattagacaccacagtaagtcagggtaaccaatttgctgaagccacagctaaaagagcagcattcaagccatcagccccaagttggaaaatggccataaaacccaaaacacttaaatacatgttgaaagaaacccagagcatagctcctacaaaagagaaatctacttggaaacaggcagggggatacttgtctcccaaaactgaaatatggtgtggacctaattattccattccaagaaacccattattccaatggaatgtcaggtgtcccttatgaaatatgttcataatctaacccattggaatccagataaaataatatcctggtgtaaacaatattactggaaaccatccttcacagtggcacaaaaagtttactctcagccgggcaccatggctcacacctgtaatcccagcactttgggaggcccaggcaggtagatcacctgaggtcaggagttcaagaccagcctggctaacatggcaaaaccctgtatctactaaaaatacaaaaattagccaggcatggtggtgcgtgcctgtaatcctgcttcttgggaggctgaggcagaagaatcgcctgaacccaggaggcagaggttgcagtgagctgagatcacgccattgcactctagcctgggcgacaagagcgaaactccatctcaaaaaaccaaacaaaaaagtttactctcaatgtgttatctgtcccaaacataacccaggaaaacccctccatggggcccagggtcattttccccttccggctgaccttttgaggtatgacagcttgattttatccagctgccatcatctcaatgttacaagtatgttttagtaatggtctgcatgttttatcattgggttgaagcttttccctgcaggcaagcaacagccacgacagttggaaaaatcctactagaaaaaattgtcccactgtggggagtcccctgtgaacttcacagtgatgggggatcatactttactggccaggttactcaaaatatttgtaaaatttggcccatatttcaacatttccattgtgccaccatccccagtcttcaggcctggtggagaggaccaatggaataattaaaacacaattggctaagttcacagaggcatttcacctcccctggcccaaagcactacccctagtgctgcttatactacgatccactccttttggaaaacatcaactgtctccttatgaaattataacaggaaggcccatgtgtatgggaacgaacataaccaatccaacttttctccagggagatatattgcaatattgtgagggactcatttatcatcttagaaaaaaccaaaatttgttaaaaaattcctttcacggtgcgctccccgaagataaggtgcctggtcatctgcaacctggagatttcatctattggaaaagacatctaataaaggattcccttcaaccctgatggaagggcccgtaccaggcactactgactaatccatgtactgcaaaattaaagagtatagattcatggattcacatctctcatcttaaaaaggcacaacctcctgagtggactgtaactcccaccaaagaccttcacctccggttcactaaacatcaacctgcaacccaggattagaagcagacaacagctgttgtggactgcttaaacccaagacacagaaccaggcctgtatacaaagggaacgcctctgtttattgtacagtaaccattacaattattgtcctagatataccggcaactgctgtcttataaatgacagggcacttgccttgtctgatttaacaccatttagtaactaaaatgaatttcgcaaccttgctattattaatcctatatccctacactttcttgccactgccacccactgatgcccatgaaacaaacctgtttctacaatgggctcagcattatgcagacaaattacaaagaacacctgctggatatgcagactcatgcctctttccagtggctccagcctgccatggtggatatcccccttccaaggtcaggactggatagaataccaaaaatttatcacatcacagaaatggtctggtattcttagtgctgggataacaaaagacaatacatacaattggcccattaaaaacactcttaagaacaagggacatgggaaaagattttgaatggaaaggaccaggtcattagctctcactttagcatccccccagctaaaacagaaggtggtaaccacaccccaaacaacagctcattttcaaaatggaataatgcaaatttgggctggatttatctggctcacccgttcgtctggccaactcagccaaaattctcctctgtgctgggagaaagaaaccatatcaaggacctatggccaaacagtacgagagatacggggtggacacctggagaatgctgtgaccacattatcatattacaagacgctgactggaatgccaccgattgggtgcagcaatcaggtatttattggatagctccaaatgggacatattggctatgtggcactaacttatggccgtggttacctctagggtagttaggatgatgttccctaggttatgcttgggcacaagacacgtaatccagaccctgccaaaaccagcaaacctttttcatttacaatttcattggacatgttaggtattccaatggtatgatcacttagctttaatctttgtaccacagacaggtattgaagatgttatatggcatatagaggccttacccaattacatccaaaaggccctgaatgatagccacatgagtattgccttgctaagcaatgaggtcatgcttatgaggaaagttgtgctatacaaccatatggctttagatatactcattgcagcacaaggggggacctgtgccgtcataaaaactgaatgttgtgtgtatattcagatgaattgaagaacataactcgatttatgactgatatgaaaacccagataaccaacctgtcagatctaaaaccctcactaatcaattggttgagtagttggtttggatcctggggaacttggtggcagaagctactgcttataataggaataataataatttgtgttctgtcctgtttctgctacaatgttgttacggtatgtgcttgcaaataagttaatgcacaactgaaagggctggggtaataattgcccagagaattgctttaattgaggaagcagtaatatagcttgacccagcttcaaggtttgctttccttttgttgctataaatatgacctaggtccctatatatatatttttttctttttcttttttcctttcctttttccttttttcctctcccttttttttttaaatattcgtgggacacaatttcctaggaatgagccttcctagcgacaatgggcgtgacttcctaggaatgagccttcctggtgatgtgggacctaaacttctagaaataaactatcctagcaacaggaaaccagttcagaaaagggaggaaaaatcaacctgtagccaagaacccatattccttttaaaatgcttccttcaaaagattttaaataaaaaaagaggggaaacctgaaaggaaattaaattttgggaccccccaaactcatttagcaaaaggcaaaagtcaaaatgggaactgggtcatccaaacctgcctcccccttttggttcctcaataaaattgttacaagatgaaaagctacatgtctcctccatattttgcccacagagaaatttctagtgagttgttaaaatttcaccatggcaatgcaaatcgatagcttatctttacaggtgcagtcgcccctggcccaccagacataaatgcatatctgagtgttcccctgcccaattttgtctatgttatcttatgtaaaatgcagattccccagatttttcctctgccccttttatgtcatcttttatttatttatttatttatttatttatttacttatttattttgagatggagtttcgctcttgttgcccaggctggagtgcaatggcacgatctcggctcacagcaacctccgcctcctgggttcaagcaattctcctgcctcagcctccagagtagctgggattacaggcatgcaccaccaatcccagctaatttttgtatttttagtagagatggggtttctccatgttggtcaggctggtctcgaactccagacctcaggtgatccacccgcctcggcctcccaaagtgctgggattacaggcgtgagccaccacgcctggcctttttgttgttatttagttttatttcatatcataaacttaactctgcaatccagctagacatggaaaggaacaaggaaaacatggaacccaaagggaactgcaatgagagcacaaagattataggctattgccagcaaatggggtggaggggtgctctcctgagctacagaaggaatggtctggtggttaagataaaacacaagtcaaactttaataagttgtccatagtcagcaatggtgatcttcttgctggtcttgccattcctggacccaaagcattccatggcccccacaatatttatgccttcttttaccttgccaaagaccacatgtttgtcatccactcagtcttggcagtgcagatgaaaaactgggaactgtttgtgtccagcatttgccatggacaagatgccaggacctgtatgctttaggatgaagttcttgtcatcaaatttctccctgtagatggacttgccaccagtgccattatggcaatgtgaagtcaccaccctgacacataaaccctggaataagtctgtgaacgcaggaacccttataaccaaatcctttctctccagtgtgcacagcatgaaatttttctggtgtcttggaaacttgtctgcaaacagcttgaaggagatgtggcccaagagcccaccatctatggtgatgttgaagaacaaggtggggttgaccatggctgatagtacggggctcctggcagcagcagcatctgtgaagtggccattctatgttatcttatatttaaaaaatgcagatttgctgaaccagacaaaggcatgaatgactatttttccctaccccctcttacatgaaaattgtttacttctcaatatcctaccctttcccctttaaatttgaagccctcaaaatcaccttcggagaaaggcatagacctgtctcctgggcacgtccttaactttggcaaataaatctaaaatcattgggacttatttcatcatttttctcaattgacaaaacatttaaaaaataatacagactggacccagcctgcccaactcccagtggagagcaaggtttccttctattttcataggcaaccagaacaatgttctatgcacattttgtcctcagtaagagggcctctggccaaaatttggctagcggcccattgggataagaagctaaccaaagcccctgtgttacagtgtaatttagagagcagcatggagagtatcatctcaccaaaggtgaagatagcattacggacatcaggacatctcttactgggagtagtttgaatctatcacaggaaagccaaatatcttcttgcagactgtaatgaagcattcattaagataaagatggctttttgatcaggtgttgacctgcctgaggaaaatcaggaagcagcttataacaccattactttacttgaataatttcatgactttgatcagccactgcctgacttagatgacatcgatgtggcccagaagttcagcctgggtcagagtagagtggaagaaataaccgtgagagaagaagttgggaatatcagtattttacaagaaaatggttttggcgattttggaatggatgatcattgagatcagagaaagcagtgcttttgaggatgatgacatgttagtaggcactactgcttctaatctcctattagagtctgaacagagcaccagcaatctgaatgagaaaattaaccatttagaatatgaagaccaatataaagataataattttggagaaggaaatgatggtggaatattagaagacaaacttattagtaataatgatggtagtatctttgatgatccccctgccctctctgaggcagaggtaatgttgccagagcagcctgcacatgatgatatacgggtgaggatgataatacatcaatgggtgggcctgatagtcctgattcagtgaatcctgttgaaccagccaactatgactgatcaaacaacacttgttccaaatgaggaagaagcatttgcattggaacctattgatataactgttaaagaaacaaacgccaagaggaagaggaagctaattgttgacagtgtcaaaaacttggatagcaagacaattagagcccagcttaatgattattctgatattgttactactttggatctggcaccacccaccaagaaataggtgatgtggaaagagacaggagtagtagaaaaactgttttctttacctgctcagcctttgtggaataacagactactgacgctctttacatgctgtcttacaccacttgtaccagaagaccttagaaaaagggggaaaggagggacagataatttggatgagttcctcaaagaacttgaaaatccagaggttcctagagagaactagcaacagctacaccagcagcatgatgttattgataagcccattttggaagagccaagccatctccagaagtcagtgatgaggccagcagaacaaatctggatgagtcagctatgcctccaccaccacctcagggagttaagtgaaaagctggacaaattaacccagagcctgtgatgcctcctcagcaggttgagcagatggaaatactgcctgtagagcttccccaagaagaacctccaaatatctgtcagctaataccagagttagaacttctgccagaaaaagagaatgagaaagaaaaggggaaaaaaagatgatgaaggggaaaaggatgaagatgtttcagggggtgatcaagatcaggaagaaagaagatggaagaaaaggactcagcagatgcttcacggtcttcagtgagctcttgctaaaactggagctgaatctatcagtttgcttgagttatatcaaaacacaaacagaaaacaaactgttgcaaagttctacagcttcttggttcttaaaaagcagcaagctattgagctgacacaggaagaactgtacagtaacatcatcgcaacacccgggccaaagttccatattttatgaggagctagaagcattatagctagtgttcatttcactagtgcttacaaattgcccccatgtgtaggagacacagaaccctttgagaaaacttagatttttgtctgtacaaagtctttgcctttttctttctcattttttcccagtatattaaatttgtcagtttcatctttgagggaaactgattagatggatgtgtttgtgttctgatggagaaaacagcaccctaaggactcagaagattaacagttcagaacagatgtgtgcaatattggtgcatgcaatgatgttgagtggcagttgaaagtcatgatttttatcttagttcttcattactgcattgaaaaggaaaacctgtctgggaaaatgcctgacagtttaatttaaaactatggtatgagtctttgaaaagaaaaaaaaaaagcctttccatcagtagtaacactggcaatcttcttgttaaccactctccttagggatggtacctgaaataacaaaggtcaccctcttgagattcgttttaagtgtaattccctaatgagcaaacgtgtacgtgaaattgtgttgtgactgatacccttcagctacagataggactgacttggtttaaagtgttctattttgtaaatcattccatttgagtctttctgatgaacttcgctatctcgaaatctgtcattttagtgaggctccaaaatgagcagaaataggcctgattagagtagagtgactatcaaatagcagactttctaggacctataaatagaagttttaaaaagatgtttggatatatttgactattcagatcatgaaaacagaaattaccctgcctactacaaggacagactgatgggaaattatacaccaggtcaacttaacctttaagcagacaatgctgtaaaaactaatggcttctctgatatttattgtaagttttagtactgatctccttttccagtgctgcacactcctgtgtttggaactttaatagctttgcaacgaaatcctatatccggtttcctataatttaactgaagaaaaacacatccaaataaaggtctatattaacagaccagatagcatcagaaatcatgtgactattatgattatcagaatatgtcttaactttttagggcaaaattaacactgaaagttctagcttaagtgttgacactttcgtggggaaaaaaatcacttttgaaacagacttcagtgtatactcaataatttaaaattatgtgaaatgttttaaatttgtgaactcattactgttttaatgattccgtttcttgagagtttaaccataaaaaattgctattgcagatttattttcaatatgctgtgcctgtaaaccatggagttttccctgtttgtaaaaagacattgtagataattgaatgtttgattttagaaaggtcattggtttcttgttacacattttgttagtctgttttttttgcttattgggtttaatattgttcttgaaaatagttgatgctatgttatgtataactcttctaataaaagttgtgttataagttgaaacaaattatagtattacagactggctacaataactttataggaagtctgaaaaatactcaaagttctatagcaaccaagcaaacacctagtcaagaaaacgatacagtcaaaatggttagaaattttgtgacatttttacttgcctgtaccccatccttccctcctggcacacctggggaagcagcagccctgctcccaattccctccctggaaccccagagagaggaaagtggactttatttgcaacattctaacctgtcaaggggctgcctgaggtactggtctctgttttacctaattcggaggtcagacagggaaaagcaacatggctggatactcaggctcaggaaaagccacaggaaatgatgggcactactcatgaacactgcagggggcctacaaactcacagatacctggagcaagagatcagaagtagaagaatacaatagaacatctaagcccaccttctgagaagcagaggtgagactctttaggaaattgagacattttaagcagtcatgcattcaagggaactggaaaacaacaacaacaacaacaacaacagatacccaggccaaggcaaaatgcatagccaaaagaggtctaagaagaccttaagacctcacatggggctgatcccaaagctgacagcatgccctgctaattagtgaaggtcttccctggcacagaacctacttgtaatgactagcagaggtggctgtttttttgaatgatcaattttaaaaatgaacaaaaaaataacaaaccatgcaaagaaacaggaaaatatggcccattcaaaggaagataataaactgtcagaaactgtccctgaagaaacacaagcatcagaagtactagacaaagacaaaatgtcttaaatatgctcaaagagctaaatgaaaactcaaagaactaaaggaaatgagaaaaatgacacataaacaaaagagaatattaacaaagagaaactataaaaaggaaccaaacagaaattctggagctgaaaatacagtatctgaattgaaaaacgcctagagggattcaacagtagattcaaacaggaagaaaaaagaatcagtgaacttgaagataagtcctttgaaattattgaatctgaagaccaaataataataataataattaagaaaagtggacagagactaagagacctatgggataccatcaagctaaccaatatatgcattacagaaatctcagatggtgacgggataaagaaaggagcagaggaactatttgaaaaaataatggctgaaaacttcccaaatttgaggaaaggcattgattcacaaatccaaaaatcttgctgatctccaggtaggataaacccaaagcagtacataccaagacacattatattctaacaaaagccaaagacatggaacactgcagggggactacagactcacagaaaccgggggcaagagatcagaggtaaaggaatacaatacaaagtctaaggccccctcaagaatcttgaaagaagcaagagaaaagtaactcatcatgcacaatggatcttcaataacattatcagtggatttctcagcaaaaaccttgaaggacacaaggaattgaataccatatttaaaggaaattttttaattgttatttttccataagttattggagttcaggtggtatttggttacgagtaagttatttaatggtgatttgtgagattttggtgacctgtcaccgaagcagtatacactgcactgtatttgtagtctttcatccctcacccacctcccactcttccctccaagtccccaaagtccattgtatcattcttatgcttttgtgtcctcatagcttagctcccgcatatcagtgagaacacgtgatgcttggttttccattcctgagttacttcacttagaataatagtctccaatctcatccaggtcactgcaaatgctgctaattcattcctttttatggctgcacagtattccatcatatatatataccacagtttctttatccacttgttgattgctgggcatttgggttggttccatgattttgcaattgtgaattgtgccgctataaacatacatatgcaagttatcttttttgaataatgacttcttttcctctgggtagacacccagtagtgggattgctggatcaaatggtagttcacttttagttctttaaggaatctccacactattttccatagtggctgtagtagtttactttccaccagcagtgtggaagtgttccctgtttaccacatccacaccaacgtctactgttttttttattatggccattcttgcaggagtaaggaggtattgcattgtggttttgatttgcatttccctgatcattagtgatgttgagcattttttcgccatttgtgtatcttttgagaattgtctattcatctccttagtccactttttgatgggattgtgggtttttctttcttattgatttgtttgagttcgttgtagattctggatattagtcctttgtcagatgtatagattctgaagcttttctcccactctgtgggttgtctgtttactctgctgactgttccttttctgtgcaaaagctctttagtttaattagatcccagctatttatctttttattgcatttgcttttgggttcttggtcatgaaatccttgctgaagccaatgtctagaagggtttttccaatgttatcttctagaatttttatagtttcaggtcttaggtttaagtccttaatccatcttgagttgatttttgtataaggtgagagatgaggatccattgtcattctcctacatgtggctagccaattaccccagcaccatttgttgaaaaaggtgcccttttcccactttgtttttgtttgctttgttgaagatcagttggctctaagtatttgggtttatttctgggttctctattctgttccattggtctacgtgcctatttttataccagtaccacattgttttggtgactatggccttatagtatagtttgaaatcagctagtgtgatgcctccacatttgtcctttttgcttagtcttcctttggctatgcgggctcttttttggttccatatgattttgggaattgttttttctaattctgtgaagaatgatggtggtattctgatagagattgcattgaatttgtagatggcttttggcagtatggtcattttcacaatattaattctacccatccatgagcatgggagatgtttccatttgtttgtgtcatatatgatttcttacagcagtgtttgtagttttccttgtaaaggtcttttaactcattggttaggtatattcttaagtgttttttttttttttttgcaactattgcaaaaggggttgagttcttgatttgattctctgcttggttgctgttggtgtatagaagagctacttatttgtgtacattaatcttgtatgcagaaattttgctgaattcttttatcagttctaggagctttctggaggagtctttaggggtttcaaggtaaatgactgctatatataaagtttcagtggcacaaaagaaatagcactcaaatataaaattttctttttaattctcagcaaggctagttacttctctatagaagggtgtgcccttacagatggaacaatggtgagcgcacacttggacgaggggaagggattcttatccctgacacacatggcccctgctgctgttgttcccctattggctagggtcagaccgaacagactaaactaattccgaccagctaatttaaagagaatgacggggtgagtgctttggagggagtcagggcagagcaggtagcaggtaaatggaatgagttagggtggagcaggtgattggaatgtagggtggagcaggtgatcagaatgagtcagggtggagtaggtaaccgaaaaaggttgctttacgaggaagttaagtttaaaagtagaaggcaaagaattgaacatactgacatattaattcttcgaaaagaaatttagaactcatatctaacatgatcatatcatcagcaaacagtgacagtttgacttcctctttaccaattggatgccctttatttctttctcttgtctgactgctttggctaggacttccagtactatgttgaagaggagtggtgagagtgggcatgcttgtcttgttccagttctcagagggaatggtttcaacttttcctcaatcagtattatgttggctgtgggtttgtcatagatggattttattacattaaggtatgtcccttgtatgccgattttactcagagttttaatcatataggaatgctgggtttcgtcaaatgctttttctgcatgtattgtgatgatcatgtgatttttgtttttaattctgtttatgtggtgtataacatttattgacttgtgtaggtaaaaccatccctgcgtccctggtacaaaacttacttgatcatggtggattatctttttgatatgttgttagaactggttagctagtattttgttgaggattttagcatctgtgttcatcaaaaatattggtctgtaattgtcttttttggttatgttctttgctggttttggtattaggatgatgctggcttcatagaatgaattagggagggttccttctttctctgtcttgtaaaatagtgtcaaaaggattgataccaattctttgaatgtctgctagaagtctgctgtgaatccgtctggtcctggacttttttttgttggtaattttcttaattaccatttcaatctcactgcttgttgttggtctgttcagggtatcttatccttcctgatttaaactaggagggttgtatttttccacgaatttatccatctcttctgggttttctagtttatgtgcataaaggtattcatagcagccttgaatgatcttctgtttctgtggtgtcagttgtaatatctcccatttcatttctttccttttttttttttttgagatggagtctcactctgtcccccaggctggagtgcagtggtgccatctcagctcactgcaacctccactcctgggttcacgccattctcctgcctcagcctcccgagtagctgggactacgggcacccaccaccacgcccagctaattttttttctgtttttagtagagacagggtttcactgtgttagccaggatggtctcgatctcctgaccccatgatccgcccacctcagcctcccaaagtgctgggattacaggtgtgagccaccgcacccggccctctcccgtctcatttcttactgagcttatttggattttctctcttctttacttggttaatcttgctaatggtctatcaattttatttgtctttcaaagaaccagcttttcatttcatttaccttctgtatttttgttcatttcaatttcacttagttctgctctgatcttggtgatttcctttcttctgctgggtttgggtttggtttgttcttgtttctctagttccttgaggtgtgaccttagattgtctgtttgtgctctttcagactttttgatgtaggcgtttagggctatgaactttcctcttagcactgcctttgctgaatcccagaggttttgatagttgtggcattattgtcattcagtttgaagagtttttaaatttccatcttgatttcatttttgacccaatgctcattctggaccaggttatttaacttccatgtatttgcatggttttgaaggttccctttgaagttgatttccagttttattccactgtggtctgagagagtgtttgatataatttcaattttcttaaatgtattgaagctcattttatggcctatcatatagtctatcttggagaaagttccatgtattgttgaatagaatgttttattctgcagttgttggatgaaatgttctgtatatatctgttaagtccaattgttccaacgtatagtttaaatccattgtttctttgttgactttctgccttgatgaactgtctatggctgtcagtggagtaatgaagtcctccatgattattgtgttgctatctatctcatttcttaggtgtattagtaactgttttattaattttggagttccagtgttaggtgcctatatgtttaggattgtgatattttcctgttggaaaggccttttaccattatatactgtccctctttgtcttttgtaactgctattgcttcaaagtttgttttgtctaagaatagctacccctgctcgtttttggtgtccatttgcatgaaatgcctttttccacccctttattttaagtttatgtgagtccttatgtgttaggtgagtctcctgaaggcagcagatagttggttggtgagttcttattcattctgcagttctgtatcttttaagcggagcatttagaccatttatattcaatgttaatattgaaatgtgaggtactgttgctttcatcatgctctttgttgcttgtgtactttggtttttgttgtttttgctttttaacttatatttttgtttcataggtcctctatgatttatgctttaaagaagttctgtttttatgtgtttccaggatttgtttcaagatttagagatccttttagcagttcttgtaatggtggtttcctaatggcaaattctctcagcatttgtttgtctgaaaatgactgtatctttccttcatatatgatacttagtttctctggatacaaaattcttggctgataattattttgtttgaggaggctgaagataggtccccggtcccttcttgcttgtagggtttctgttgagaaatctgctgctaatctgataggctttcctttataggtaacctggtgcttctgtctcacagctcttaagattctttccttggtcttaagtttggataacctgatgacaaagtgcctaggtgaatatctttttgcgatgaatttcccaggtgttctttgtgcttcttgtatttggacatctaggtctctcgcaaggccaggaaaggtttcctcgattattcccttaaacatgttttccaggcttttagaattctcttctttctcaggtacactgattattcttaagtttggtcatttaacataattccagatttcttggaggctttgttcatatttccttattcttttttctttgtctttgctggatggggtaattcatagaccttaaagctctgaatttctttattctacttgttcagttctattgctgagactttccagagaatttcacatttctgaaagtgtgtccaaagtttcctgagtttttgactgtggtttctttaagctatctatttccatgaatatttctcccttcacttcttgtatcattttttgaacttccttgtattgggcttcgcctttctctggtccctccctgattagcttaataactaacctcctgaattctttttcaggtaaaccaggtatttcttcttggtttggatccattgctggtgaagtactgtaatttttggggggtgtggaagagccttgtattgtcatattactgggtatctcagccgtggataccagcacctgttccaatggaggtggcggagggtgcaatggactccgtgagggtctttagttttggtgatttaatgctctatttttgtgctggttggtctcctgccaggaagtggtgctttccagaaagcatcagctgtagtagcgtggagagggactggtggtgtgcagggccctagaactcccaagattatatgccctttgttttccactacgagggtggataaggaaggaccatcagatgggggaagggctaggcgtgtctgaactcagactctccttgggtgggtcttgctaaggctgctgtggaggatgggggtgagattcccaggtcactggagttgtgcacctaggaggattatggctgtctctgctgagtcatgcaggttgtcagggaagtgggggaaagccggcagtcacaggcctcacccagctcccacacaaactgaagggcaggtctcattcccaccgtgccctgaccaacagccccaagtctgtttccatgcggagagtgagaagggcttgaaaacttgctcaaggctatctgcctcccagctgtgagagaaaagggctttaattcttctccctgcctgtgaagtatgcatgcccaattcacgccctccgctgagttctggccaggaggcttctcgccacattcaaattgttacaaagttcagctagagaattccttctccctgtggagtttcaccccctgctcctctggccgatggatccctgtggtgccaggcaggaatgggctgcttgggtcccagcaagttcctgggtcctctacctctgtatttcactcggctctctaacttgactcagctccaggtaaagctggaaacttcacctgcaaacagaccttcagcctctccagtgggggtgtgtcttcaggagaggagggtctacctttcccacttccgcagttgggaaactcacaggaattttttttttttaatgtcaacagataattctacatcttggaaaactgcccttcagaaatgagggacaaattaagacattccaagataaataatagtcaacattgcatgggaatttttggccagaacaattaggcaagacagaaacaaaaggcatccaaattggaaaggaagaagtaatattatctctgtttgcagaggatatgatcttacaggtagaacactgtaaatatttccccaaaatcactgttagaactagtaaatgaattcagcaaaaatgcagaatacaaaatcaacacacaaaaatgagttatgtatctatattggcattaaacaatctgaagaggaaattaagaaaacaattccatttacagtagcattgaaaataataatattcttagaaataaacttaaccaaagaggtgaaagacttgtacacagaaaactacaaaatgttgctgaaagaagctaaagaagacacaaatagatggaaatacatcccatattaatgagttggaagacttaaaattgttaagatgtcaatactacccaaagtgatctacaaattcaatgcaatccctattattaaataaaatcctaattatgtttttgcagaaatagaaaaatcaaccctaaaattcatatggaaattcaaggaatcgcaaagaaccaaaacaatttcgaaaaaaaaaaattttttttaacttggtggtctctcacttcctgatttcaaaactacaagctacagtaatcaaaaccatgtggcataaagacagacatacagactaatggaataataaagagcccagaaataaacccttgcatatatggtcaaataattctcaacaagggtgccaagaccatccaatggggaaaagaaagtcttttcaacaaatggtgctgggaaaactgtatgtccacatagaaaaaaatgaagttggacccttaccttgcaccatgcaaaaattaattcaaattcaaattagattaaagacctaaatgtaagagctaaaactataaaactcttagaagaaaacatagggggaaattttcgtaacaagatttagcaaagatttcttgtatctgataccaaaagtacaggcaacaatttaaaattatatgagttggactccatcaaaattaaaaacttttgtatatcaaaggacactatcagcagagtgaaaaggcaacccacagaataggagaaaatatttgcatatcatatatgtgataagggactaatatccagaatatataaagaactcctatgactcaacaacaaaaaaaacaaacaacctgatttaaaaatgggcaaagaacctgaacttcaaagaagttatacaaatgaccagtaaacatatgaaaagatgttcaacatcactaaccactagagaaatacaaatcaaaaccataatgaaataccatttcacaccccctaggatggctattataaaaaacagaaaataacaaatgttggcaaggatatggagaaattggaactcttgtgcattgctgtaggaatgtaaaatggtgcaaccactgtcaaaaagagtatgacagtttctcaacagatcaaacataaaattaccatgtatattagtcaaggttctccacagagacaaaaccaataggctatatatagagagaaagatacaagaggggatttattaggggaattggctcatgtgattatggaggctgataagtcccacaacaggctttctgcaaattggagaccttagaatgccagtagcatggccccattcaagtctgaaggcatgagaacccagggggctgctagagtccaaaggataaagagcctggagtgctgatgtctaagggcaggagaagagtgtatcccacctgcaagagcgagaaaaatctctctgctatttttgttctatcctggctccagctgattagatggtgcctgcccacattgagggcaaatcttccccacttagtccactcacactcacatgccaatatcctctgtaaacacactcacagaaacaccaaaaaataatgcttcacctgttctctagttattccttaatccagacaagttgacacctaaaactaatcatcacaccatgggacctagcaattccacttctgggcacaaaagaactgaaagccgggactcaaagagatacttgtatacccatgttcatagcagtatgattcacaatggccaaaaggtgaaagcaacccaagtgtccattaacagatgaataaacaaaatgtgtatttatatataatatatatacaataaaatattcagtcttaaaaactaaagaaattctgacacatggataacatagatgaaccttaaagacattatgctaagtgaaataagtcaaccacagagggacaaatattgtatgattctacttacatgatgtacctagagtagtcaaattcatagagacagaaagtagaacagtggttgttaggggctacgaggaggggatgggcagttagcatttaatgggtatgaagtttcattttgggaaaataaaaaaattctggagatgaatggtggagactggcgcacaacaatatgaatgtacttaatgaccctgaactgtacacttaaaaatggctaaaatggtaaattttaagttatttatattttactacaaaaaaaaggtaacatactaaaatgatctcatgggttttgtgagaatcaaatgagatccatgtagagaagccttgtagtctatatagcccttcgcaaatgttagctcttcttagtcattatcactccattttccccaatctgataccattatccacacactttacccagccacacttacccaacagcacactgtttgagtttgagtgctatctggtgaatactcatcttcattttgctaaaccctggatgccatgtgctagccaacaatatcctattgttctggttcttaaacaaaacaaaatctcaaagacttcttcctcttacctagttttacccaatgattggctttgaagcagtccttattcagtaataagaggtcaccatgccatggccaagaatagggcaaatcttcctccaattcagttgaactccctggccgtctagcaaacaacatatctcataacacatcctttgagcaggtgaacaactctgaaccttctttgaaggaacaggattctgggaaaggaataaaagaaatgcatgcagtgtgtattgagaataaaatctattagctaagaaataaaaaatgaaaatgctacaacatgatcagttttgatggactagacaactctctgtagagtagccacagggctgaaccctcaaatattcccagaaagtatagacattgctgtagaaccagcctgataatgcagcagtgcagaacttaagaatgatatttctttctagaaagcagaccaattgatatcttcatcctgttattgatcagaatccacgtcagcattcaggtgctctctggctacaagtttccttagctcttgcaggcgctgctcattgaagatttctcttaacacaggtaatgctaccagtctcatctggcacctttttcatgcaatgacaactatccaggagttgctgcctttccagatatcccctgcgagaccaatgagggattttattccatgactctttgaagaggttcaaacatggatcaaacatgaagtagtatgtaccccagccttagaaatttaatcttttatgactgggagaaagaacccaagtctctgtgccttcacagtcttgaatatctctgcttgtttcacttacgtttacctcactcaagattcttagtgtcatcgacatgactggttaagaactcaggacttttcaacaaagttttctgccagtgccccacaaatcatgactgtggtctcccaaattctttgattctccactaggttccctttctcctccattcaaagccccaaataacatttaccctatatatttagtcccgttttttgtagaaatgcttctttgcttgtgttccccctaccttttcatatcatacctacatcgttaactgaggctcagtcataacatcaacaacagcatgaaacatcccaccttctgtcttcattttgctataaactggaggcaaaggaaatgctgtcactcagggagtatatcaatgaagggaaagactctcacaagacaggcactgaggcaggagtcactagcacacagtgtataagtgaaatctaaatataaaaaagcaagcacttgggatacatcccttgcacacacctcctcttttataaccagtagagtgaagttggttgctgaagtcacagaatcaatagtctatttcccacagacggctgatgatagcagaacaagccctggctaagtcccccacccttttcttgagtagctcattgttatgagccacggacccaccatcaccaggtcacatgttctgtactctttcctaaaaacagtgacaaaatatgctgagccatccatatttcctcagttacattgagaggcaggagatataacaattaagcagtctctggagccagagcaacctgagctcaaaccatgccttagcttgcttgttgtgggacctaggcaaagttactgaaacttctttagacatgtttatcaataaaatgggtacagttgactggctccaagatttcttgacctcttgatgtatttgccctgcataattcctaagactgtgattataatggattttactcttatgattaggttttcacatagcacagttgactttaatacagggagattatctgggtaggccttgcctaaacacaagagccatttaaaagcagagttctccccagctggtcaaaagagagaatctctggtcagagattcacagcataagaaggtttcaatgtgccatcactggctctgagatgtagaaacccacatgtaaggaccaaaaagaagcccttaggagctaagagctacagccctccagccaatagccagcaaagaaacaaggacctcggtcctacaaccacagccaaccaaattctgccaacaagaaaaatgagcttggaagctgattcttctcccaaagattccagataagagtacaacaccttgatttcagccttgtgagatcctaagcaaagaacccactcatgtccacccaaacttctgacctacagaactgtgagctaacaaatgagtgttgtaagccactaagtttgtggaaatttgttacacagcaatagaaaactaatacaatgaggacacagcaagtgcttaataaatgttagcttttattattactaactcattgggatcagctacacagttgtaagaaggctaaagtaaaaattatttatgcaaggctggcagtgcaacatagcattcagatccagggtccatttggtctaatatggctgatattaagtgtttctcaaggggagagacattattggcattcagtggggggaggggttcatcctgtagaactgccttggacatggcagtccatttatcatctctggcttctcttcccctagcagtagtcattgcaacaactgaaaatgccactgtacatttccaaaaatgctcctccacaagggttgagaactttgagaactactttaagggaaatttcataagaaagcatgcgtgtcttaaatgctgccataaagctacctcaataactacaatgctactcaaattacctgaccctaagaatcgccagtggcacttgtttaaatataacgattcccaagttctttccctggagtcccattccatagggctggggtggagccccaggaatctatactcttactcaaagaccccaggttaatcttttgtttatgtaagtttgccaaacactgagttagaaatatactcagccgtacatgcatttagcaaaagttcaccacaacggaacaatgacacaccaaaactctttgaaactgtgccttctacagagctgtaaatctccttttggaccattccattacacaaggtgtcctcttggtcacacagtgattgcaaatgggactctagagtcatggaaatgggtatactcttctcaaactttccatctttaccagaattacttcttaaagtgatatgcttcatggtgtaaactagcacttattaattttttctaaatatttatcatatttcatatacttttattttggagatggagtttcgctcttgttgcccaggctggagcgcaatggcagatctcggatcaccgcaacatccatctcccgggttcaagcgattctctggcctcagcctcctgagcagctgggattacaggcatgcgccaccacgcccggctaattttgtatttttagtagaaaaggggttctccatgttggccaggctggtctccaactcccgacctcaggtgatgcgcccgcctcggcctcccaaagtgttggcattacaggcatgagccaccgcgcccggcccatatacttttaatacatgtggaattaataaaaacgtccatgcctccaattccgtggctattttaccgtcttcctttttcggacaagtccctcaaaggtagcgctcttggctccttcctttgcttatcccctaaccctgtcctcctgaggtgccccctggatttcctccaaccccggcagggtctgcctttccgggatgatacaacgacctgccctgcatgccatatcccaggcgcgtgggcaccaaagtgtggaaaaaccgatgaatgacgttttctgtttccgatactctgcctgccagaatcccctgccgcaccgccccaccacgaagcacatggaacccacggactacacgaggacagaggtctgttctccctttacctctcccatttctttaactatgcttctctcggctggcatgccctttcctcatctcactccacacacgaacaggtttagcaaataatatgcacgctgctgggacgggcccaagcatttccctcccttgatagggcggaactaaaatgcaagccccacagttgtcagcaaaggacttccctgttaccatggtaaagccgctgcgcctttattgtggttgaggagtacttgcatcaacctaagagaaaattaataagaaggaagtctgcaggctgaaacccttcaaattagcctggactcgcctgcatctggctcggaacagagttaatctcaggagtgagaatatagccctccggtggacgcaactcgcgcctgcggctaacagaatgtctccaggggaggggctctgcgtccgttccgcccaggcccttccggctcacgcgccgtacggaagcgtgctcagcgctgggcttgtgctccgtacggaagtgtgctttggcgcaccggaagccgactcaacagagctatggcgggtttgactgtgagagacccagcggtggatcgttctctacgttctgtgttcggtgagaggaattcgttgtagtcaagcttcggggagggactcccctctgcaccttctatctcatgaatcgctaccggagccgctgacggttcggacgtgcagttctccctgcttatcctgtagggcgtccaacctggtggactcatgagcaaagagatattcccattctgccgaggtctcgtaggctttccgcaatatcagtggggaagttagactagcgttcagcttctgtgcgtttctcctttcatgagcttcaattattctctagaggagaaggctcacggtaacagctcctcactgtcccgtactacttctcatcctctgccccagaatacagactatatgctgagggtatagatcctagtgtccacttactgtcctctcctaaggactttcatcctttgctttttatctgtaacattttagtgcatcaatagtggtagcggccacctggtgtcctgagatggcttgtaagtgaatgaatgaatgaactattaagatctcctcagaggaattttaaaaaggatcgaaacgattctgaattatctttttggctgaaataagttgtttttaaaaatacgtgtgattattttagagtaccatttgaaagggacatgacaaagtagttcagaatactttttaaacatctttcactacattcatcgtcattctcccttaaatgttgtatgtgtggaaatacataggaacctgttttaaaaattatattaaataacattgatattttttgtagtcactgatgagacttgcagatctttaggtaaataccagtgccaaagtatttatttgcaccaaagttaaggaaaatctaacacgtgtcagatcagtctgagaactaacatttgagagtacctacacattttgtatttagtttcagtggtatatttcctttgttaagaggtctgaagaaatacaatggaattgggattggagaacactattttgagtcttatatttgatgatataagtttactttctcactaaagatctatgttataaactcagaattttaatgttacctattttcttccttagtggggaacattccttatgaagctactgaagagcagttgaaggacatcttttctgaggttggacctgttgttagtttcaggtgagatccccttttccttcatggtgggagcttcttaaaaatcaccacagatttggctcttagtaataatggcaggttttctttactggtgacttttcacatacattttgttcttgtaacagctttattgagatataattgatacactatacaattgacatttattcttacctaaaatatgtttttttcgttaaaaatgttttttaggcagggcatagtgactcaagcctgtaatcccagcactttgggaggccgaggcaggcggatcacctggggtcaggagttcgagaccagcctgaccaatgtggtgaaaccttgtctctactaaaaatacaaaaattagccgccgtggtggcccatgcctgtagtcccagctactcaggaggctgagacaggagaattgcttgaacccgggaggcagagatagcagtgagccaagatcatgccactgcactccagcctgggcaacagagcaagactccatctcaggaaaaaaaaaaaaaaagttttaaaaaatatttctgtgaggctgtcagagatataaggttatttatgttacagtgggcccaattaaagcatggcaatgttagcaggaaccctgtatgtgtgtaacatttgttcctgacacttggttctgctctccagattggtatacgatagagagacaggaaagccaaagggttatggcttctgtgaataccaagaccaagagacagcacttagtgccatgcggaacctgaatgggcgcgaattcagtgggagagcacttcgagtggacaatgctgccagtgaaaagaacaaagaagagctgaagagtgagtacaaatccaacttggatgcagtatgagttagtaaagatgtaacaatgaagattttccatttctgatatgttttagaatatgctgaaatggttagccacgcagcttgtttattacttgactgacctgatgtgcctgagttaggcaagtattatatatatctttttaaaaactttttataaattttttttcaagtaattgtctgaaatttctatacccttgctctggatggagcagggcaaggcctcaaaccgtttcaaaactgttctggcaagcactgtagggatgcatagggtcactgcagacctaagcatgctggaggcttgctagtaagtgtatatctttaagaaacagataaagttgacattagaaattcttcagttgctccagcctgggcgacagagtgagactctgtctcaaaaaaaaaaaaaaaaaaaagaatttccattgctaaggagttatttccagttaaagatgaattcaaattcatcaagccattagtagtactaactgtggcattagtcattcctgtcactcttttcaggaatttttgaagttagcgtatttttctcttttaaccttttgtttctgaaatgacttgttaaaagaagtcaatgtgcctagttctctaacttaggttaacattgtccttccatgtgatcatgatccccagctttcctctgagaacagaaaatacactctcactttcctccacagaaacaagaggctttcacatcatttatttctcagctctggagaatctaaaattatcagctggttcttacagcagccctgaaaagtagatatttgaaatgatttagctttttgttttgcctccctaactttcttgtactttcttcttgattaggccttggcactggtgcccctgtcattgagtcaccttatggagagaccatcagtcctgaggatgcccctgagtccattagcaaagcagttgccagccttccaccagagcagatgtttgagctgatgaaacaaatgaaggtgggaggaggcattaggttatgaataaagcaaatcacatcaggttttcaaggagttacttgaattagttccctgagctcaaatagaaattgtctgtagaccaccatttcttgcaccttcaatattctgtatgtacacagtatattttacattttgtacaaagagctttctatttttgtacacaaacacagctatccaaacaatccagctggagttttgtggcccatagatgtcagatgtagatattaaaatttggcttttttcctaaatgataatatcacagtatttgaaatgcctctttcttctcttgcctgccatgaccaaggtttttttgtgccatgcaaaaactaatgataaagagcctcttgaatattacatttctcagaggggaatggctctaaatcactatcagtttctaagtcataagtattaaacctgaatctgcttatcttctcagctctgtgtccagaatagtccccaggaggcacggaacatgttacttcagaaccctcaactggcttatgctttgctgcaagcacaggtagtgatgagaattgtggatccggaaattgccctggtgagtgcttctggttcttttatggaaatggtcgggtaaaccttgaatgggataggaactacctgattgctttgttaaacagacagctcataggtttgtcttttcactttttagaaaattctgcatcgccagacaaatatcccaacgctgattgcaggcaaccctcagccagtccatggtgctgggcctggctcaggatccaatgtgtcaatgaaccagcagaatcctcaggcccctcaggcccagtctttggtagggctttatcccttaacatttttttgtatctgtcttagaatgtcattttctttttaggagaatatattgaaagaagaatggtcaggaaccagagatgataatttcaatttccaggcataaaagcaatttccaggttgcagagcacatgacatctgaatgaatatagattcgattccaagtttgtaaaacaaagagatccttcccgtatgcccttttcttataagctaactttgtgtgtatgtgcatgcctggcactgtggttggcacttcgttattccatatgcattatctcatttaatcctcaaagcaattgtatgaggttggcactcttattatctccattcttactgatgaaaaaagtaaagcttgctttcaaagcatgacacaaaaccttaaagccataaaaaattgatacatttgaaaactaaaaaatttctatataaagaaaaaaataagtatcaaagacatgacaaattgagaaaaagtatttaccacacatgtgatggaaaacagactaataaagagcccatagtcattcacaagaatgtttattgccttagagtgaaaaattggaaatgtcctaaatgtacgtcagtggaagaatggagaaaatgtgtggtacattcatccagtgaaatactgtacaacagttaaataaactacacgtatcaacatgaatgactttgaaaaacataattccatacagcagttaagatgaactaggatacataatatcaacacaactccaaaacagtgacatacggacatgaaactaagtgaatatggatgcattcccgaaatgtaggatatatgtttctgcataaatccccaaaatatgtggaatgagttgcaaaataatatattgagtatgtaatgattcatataaaattttgaaacattaagaagacgtcttagtggtcatcaaaggagaagagagcacaggatgcaattggggaagaccgtacaggccattggtttattttatttacttatttatttcctaagctgggtggctattttattttctatatgatttgtatatctgtaatttttcataataaattttaaaaggcctcctataaattagtaagaaaatttccaataacccagtagaaaaatgggaaatagacataaatatttcacaaaaggagaaatataaatatataaaaatttattcaacttcaaaataagataatgtaataaattatcatttatatatgtaatgttataagataatgtaaatagaaactacaataagctaccatttttcatctctcaggttggcagaggtacagggcagggaccagcaaacatttttctgtaaatgatcagacagtaaatatttttggctttgcaagtcacaggatctgccacagctactctgccatggtagtatgaaatcagccataggcaataagtgaacaagtgtgtgtggttgtgttccgttaaaagtttgtttataaaaccaggcagtgagcccgatttggcccatgggtcatagtttgccaacccctgctctaaataaataaatacattttcagagatagaaaaaaaaagctaaggcccagagaggttagctggtccaaaaattgacacaattataagtggcagatctatttctgaacctggttttatctgacctcacagccagttttctcttaactactttcctatacagctcttccttttcttttgtagagttttgtgttccttaaacgtatatgtgattttttttatataacttggcttttattctttatttattgagctgtttctaattcaagggactactcagttttttggggaatgcacagatgaaaagatgacattctctttttctcaacgagttttaatgtagcatttaaaaaaatatatttcacattcccccaaaaccagaattatatctaaggacaggagtgagaaaagattggttaaattaaaaaaaaaatttaattttaaaaatgtggactaccagcagttgttttttttaaaagagtcccagtctccttttatgtttcttgggtttagggcttttttttttttttttttttactcttattggcagccccaatcatgaagttaacagtaggtgttatgtgctgccttgccacacagataagacttgtcaatctctacattgagaatatgttccatcttaaccgtgttccatataaccaggctcatgacgtatattgcttctgtggagtttaaagtgtgtgacaaatctaatgctgcataagacatgccatacaaaaaggatgtttagtagtgtatttggggctgttcatttgaagaggacttttaaggtcgtagacttagtatattgagtatccacagaggcatatacatactctgttttttttgcttggtcagggtggaatgcatgtcaatggcgcacctcctctgatgcaagcttctatgcagggtggagttccagcaccagggcaaatgccagctgctgtcacaggacctggccctggttccttagctcctggaggtaagtttcatttagtcttcaccatttcagtacttgctaaagttttgtcatagccactgttgcagtgcagccaaatatgataatgggatccttaggtaaaattaatacacagctagaaagtatatatcttaggtggaggaaatagtagatttcttacgttaaatcctgtatgtctaattataagaacagggaaagggacagtaaagtgaaagagcatagtaaaacttccaagttaacaagggggaaaatggaatgagtggaaacaaaatcaagccagcaaaaatagagaagaggaaaaaagtaagagacagtgtaaaataagtaataataaatgtagagtaagatggaaggaataaaaactaatgtagttgttactctgctaaatatgaatgaactgtcagattaggttcaaaagctcatgaagaaaacagacaaaaaaatacaaggtcacatttgttatagcatattaaactgacataaaattgtattttaacaaacataatcagaacaaacaacaaaagggaaaaagagaaatttaaaagctatgtacatttattgaaaatgtatagatcggcaattaataagagtattgctcatatacttgtaactgttccttgttcaacaattgtaactaagaagattgagtgaaataatgattccccatatgaaacatctgtatgaacacatgatgtattaccaatatttaaagtttttttatgtaacaaacttggtttttgttaatttatctaatctagggtaggttgagtacaacactactcatggagaatgatttaattctaaattgttctgttctgtagagaatccagtctgcagagctaagttgatgaggaatggaagaagagattttttgaagaaatttctgcaaactcaggaattttttgtatctactttaggattgttatgtatctactttatcctaatagagttatacttgtatttaaattatctttcatgacaggaggtccatgggtaagtgacattgttttcctgtattatagaagagcttcctgccaagagtttggtaaccaatgaaatgaattattcttattgaactcactattctgtcactgaaacataaagtacaaattgtaaatatactaacaaaccccatcttctctctcattgcattgttgaatatcttcctttgtaggtttctgcttgtggagcagaatgaggaaatttgtaaactcagccactgttctaatttttcttttccgctgttctaattggtgttttttcttgtctgccctttatcttctaggaggaatgcaggctcaggttggaatgccaggaagtggaccagtgtccatggaacgggggcaaggtaaataaatattaatgtctgactaatgttaattggtcatggaagtgttccacatccacagtatctaatatggcagccactaaccacccatggctatttcaatattaagttaattaaaattaagtaaaatttaaaactcagttcctcagtcacaatagccacattccaagtgctcagtggccacaggtgactagtggataccatacaggacattacagatatagaacatttctatcatcgtaaaaagatctattggacagtgctggtctagactttccacctggtgattcagagtccagctctacaagaattgataatgaagcaagtggatcgtttgtttcctgattcctagtctaataattccactgacatgttctctctccctgtatggatatctgttgactgagtaaggaattttaataatgagcatgtaaatatgtggctgggtatgtagaagactagatttaaaccccagagaaaactgggagggaatcataggtctgtaacgcctacttaatgaacatatgttgtaccgtggctgtactgctatatacaacagtagctgctgctccaaaatctccatgttgtttcttcatgttactggagtttgaaggacaagaaagtgcagtggttcagttggaaacaatgttaggaggagagatcgtaagaaaagagaaggaactgagtgcatactatatgccaggcactttaattttcataaataatcttgtgagttaggtggcagcacctcagttttacaggcaaagagttggaagctcagaataagttactttctcaaggggacaaggtaagtaaatattaatgtatgagtaatgtggactggatttggtgctcttattttctcttccaactagtaagtggcagagctaagattcagaagtctttgactccagaatctgtcctctttctgtcactccacactgcctctgttaacttccaagcatattcttcagtgtcttctactcttattccttgggaataaaatgatgggaaagactgctttggacaagcatagagaagcttaaggttttttcttttgtagcatatggtttataagtggaacccatttaaaaagcaaaatattggccaggcgcagtggctcatgcctgtaatcccagcactttgggaggctgaggtgggtggattgcttgagctcagaggtttgaaactagcctagacaacatggcaaaaccccgtctctataaaaaatacaaaaactagttgggcaatggtggtgtgcacttgtggtcccagctacttgggaggccgaagtggaaggatcacttgagcccaacaggttgagactgcagtgagccataatcgggcaccactgcactccagcctgggcaacagagcaagaccctgtctcaaagaatatatatatatacacacacacacacatatatatacacacatacatacataaacattaatatacaagcctgtggtttttacactggggttggttgctgaagtgacagaattaactttttcttgttagaagtctgacagcaggacaaactccctggccaaatatctcatattttctctaagcatccaatgcttttgtgctattgtacatccctctatccccaccgcaccactgtcaatagatcatatatgttccccagagtatttctgcagtaatgagaaggtattagggtttcagtcatacttctgcctgtcatggggccagccctcaatccatcaggttttagctgtttaacgcatacttgcacaagacatcttcctattatagttatcttcacctttttgtcagaaattggcaaagggaagtgactcatgttttgagggtatttccaggatgtcttcatgcagagactaagtgagatgagctttcttttatagtttccttcagtacccagcagaggaagcaagagtcttttcgtgtgtgcctagtttgtcttacttttcctgaaatccatgctgcttttaatgctgaaaggagatggagatgtttgagaagatacttcttgcttccctgccatgtttgtttagtgtcggttcccatgtcatctcattagtctttgtttgctgttgtcatgatgtttattatcaaagacttgctgtggcagagtatttcttgtggagtgatattctctttcatcatgtaaagttcattcactgcatttccccatctgatacatttttgacagcagaaatttttgtgctttaaaatgtgacaaaaatagaattgccgtacttcagttatggccgtttcagaatgaatcttgccttccagattcagtgcagtttcttttatgttttgcttctgaaactacatttatgttctttgcataactagaagattcaaaactatcctttttatatatttttttcctaatgatttcataaggagacctaacggaaaactagtagcagaggtgaaaatcgaaaatgtcaggttattcccacctagatcaaaccagtgcccccatgggattccctttcaaaagctatctggtcaaaatggaactatttcagagacccaaaggagctagtgtagtttagggagattttgtagcctggagcaagccgatgaactcttggctttttaacttatatatgtaaatctcaatctccatgtgtgtgtgtttctgcgtgtgtatgcaagctattttaagtgtctgctctttctccttttgaacttactgcttacctaggaaccctacagcactcgcccgtgggacccgccgggcctgcatcaattgagcgagttcaaggtacccattgtatctgtgggtttccttttgcttgtggtgttcagggtgggacgttgagaggaaaagagctgcgtggcagtcatcctcgcgttcagaacccaaaagggtagtgtttttgggtttttgtttttttaattttttcctgttgaggccacaagcctaagattgacctcttcacacagggcagagaacatggatgatatgggcatctgtccgaggctgtactccctccctactggtgtcaggaggcttggatggaatagcagtctgtaaggagacagcgggttcttgcagagccatggcagtgttcacatatgccaagactctacctctgttttgtgactctggtccttgaactaagattgattagaaggaaaaccaggagcataagtttctccaggtcgcagtgctagtccttggcaggttgctccccagtttgctctttatataattccatccatacctctgacatggcacagattctgcctacaccctgcttctgttcttgagctgcaagaggattctgctgtggtgaggtttcacccactctaaggtgtctgaattatgttgtcagtggtatatagagtcatttcttgtttgcttatgtgtctttcacagcagtaactccccgtttgtttccctgtcagtgccgatgcaagaccccagagcagctatgcagcggggatccttgcctgcgaatgtcccaacccctcgaggcttgttaggagatgctccgaatgatccacggggaggcactttactttctgtaactggagaggtagagcctaggtaagcactaacatagaaggaaacagttgaagaaatcagaattgtcccttcttccctgagaacaaaatctttctgtaccagttgtacctgtttgcctacttcaaaaggtagatcaatattcatggccactgtccaagggtaagcacttctcctaaggcagaactatgtacttgagtatgtcattttgagctattatatttttagaaattggaaattttagtatacatacttgaacagggaaatttatagtagtggaaatattaataatagcaataataggccgggtgcagtggctgacgcctataatcccagtactttgggaggccaaggtgggtggatcacttgaggtcaggagttcgagacctgcctggcctacatggtgaaatcccatctctactaaaaatagaaaaattagccgggcgtggtggcgggcgcctataattacagctactggggaggctgaggcaggagaatcgcttgaacccaggaggtggaggttgcagtgagccgaggtcatgccactgcactccagcctgggcaacaagagtgaaactccatttcaaaagtaaataaataaataaaataatgatagtaataataattgacattaatggggatcatgcctctgactctgctctgagtactttacttagatcatcttattaaatccacaagatcctgtgagatggataccattattagtcccattttacacgtgaaactgatgtgtggaaaagttaaataatgtgtccaatatcacacagctaataagtgatagagcctagatttgaacccatacagtctgaatccagagctcatgttcttatgcattgttctgcaaactcatacatataatgaatattcgttgattcctccctaattatgaaccaaataacgaaattctagaatacatggatttatatctctgtagcttttcttccatctatttggtgttattttcttgttagtattcatagactacatcagctctttgttggatgtttacttactgatctggttggtactttgttgttgttttgttctattttaaaatacaacgtttttctccatctccagaggttacttgggaccacctcatcagggtccacccatgcaccatgtccctggccatgagagccgaggaccacccccacatgaactgaggggagggccattacccgagcccagacctctaatggcagaaccaagaggacccatgctagatcagaggggtccacccttggatggcagaggtaaggggagatcacattgcaaatgccataatgaactcaactgtcttaggctctaatctgggataaagaatgctggaacagtaggtttgcaagcatctttaaggtttatccacaaatctgagaaactggggaggagacaatagtctcatatgttaatagctgaggggacaaatgtgactagaagagatttctatctttcttggattgttcatcattcttgcagtacatgcaagtagctacataatggttttgttacatttttctttataggtggaagggatccccgaggaatagatgcacgagggatggaggcccgagccatggaggcaagagggttagatgccagaggattagaggcccgtgcaatggaggcccgtgcgatggaagctcgtgcaatggaggcccgagcgatggaggcccgtgcaatggaagtccgagggatggaggccagaggcatggataccagaggcccagtgcctggccccagaggacctatacctagtggaatgcagggtcccagtccaattaacatgggggcggttgtcccccagggatccagacaggtatgtgtaacactgacttctggcatccaagtgaaatcttgatctattcaggaattgattattgagcctaattattactgccttctgacttgggctgtttcttagcttgttagaaagggaagacttggatctccctgtagcttctctgtcccttagggtggtgattttctggctatcaggattgtagttcaaaaaaaaacaaccttatcccacaataaatagctattcatttggagcagagcccctgaaaatttaggggttagaaagtagtcttgattggggtacaaaccaacatcatgtacacggttttttccaagatatacttgcccggatctcatccgaggtataactcagaatctcttattagtaggatctgagcatggatagtttgaaaaacttcccccaaatgattctaatgtgaaccctgactgggaaccactgggttagagtatatgaagagctgttagtggccatttagataatcttaggtttagagagacctgtgttaatttattgtcatcacatagcctaagtgaacagtggaatgtgaaaggcagtttattaataatcaccttaaaaggtgtggaaccgaagtcttgtctcctctcttttatttggatctctctgcctgtgtgtacatgctccctcttcatctcgacttggttgtggagaggtggtatgtgtgtttcttccgtgagtttttatatgctggcaccttcatttccctctaactgctccaccttccttttccccccttcctctgcgtacttctctcttctttttttatgtgtcttcctccccatgtctgtgtgtatgagagagagaaagataatggcagagctggaatggaatacatcaatcatctaattccctcagtttatagatttggaaattaaggcccaagaattcaggtgacttgaccaaattcacatgactaaaaagtggcagagcaaggaacagaagccactactttttccactttactactctgtcctgttatctgcacatttgtgtgtgtgtatatgtgtggatatgtgtctaccccctcctctgtaatatgaaatacaaatagagggtttttttgctatgtgtagaataaaactgttctctattgtgtttgaagtgtttgtgggccttgatttttattgtactctctatggtcagtagcctagtaacagaaatggtttttatgcattcattctgtcactcagcaaatatttattgagcacctactatgtaccaaacatagatctaggtacgggggatactgcagtgtgaacagaacaaagccccttcccccatgggcttacattctagttgggaagacagataacaaacaaataactacataatgcgcttacataattttactggtagttctatgatgcaagacattgcaagtaagggttggaagaacatttctggataatattttgctcctttctctctgctggtacttgaacttattaccctaatactaggtttataccatttttattagtagattcgataaagccaattagatctgaggcaagagaaaatacaaattttatcttcaaacctttaaaaaaattttaaattaatatattaacttataaatatatatattcgttcatctataaaagatatatgtattaagaacttcaagccaggcatggtgacatgcacctgtagtgccagcactctggaggctggggcaggaagaccatttaagtctaggaacttgaggctgtggtgcattctgatcgcacctgtgactagccactgcactccagcctgggcagcatattagactcccatctttaaaaaaaaaaaaaaagccagggtagaatcctgtagtcccagctactctggaggctaaggcaggaggatcagtagagcccaggagttggaggcccgcctacacaagatagtgagaccacatcttaaactaaaaggaaccttgcttcctctcctatgcttgtctcccctgtggccctctaggtcctgtagataatcacttttattagatttttcatgttactttctggaaaacatgaatatatattatttttcccctttcactgttctataccttttttttttttaacttaacaacatgtccttaattcatacttttaaattagattttaaaattaactctagtccacttagttagaaacttgtgggcaaaaggcttattattactagggtgattatataatttatcatctaaaggagaacatgaaagaaagtgctgttactttacttggaggcaaaaacataaactgggactatcttagggaaaccaagatgtatggtcacttttgctagtacttgtctgcctagaacaagcacacctagaaacttaaaatggccgttattgagtggttagatcacaattacagtacctcagattaaagcttcaaaaagattatactcaattccgaattgtgctgctataaactcatgtgaccaaacaccacctgttccccaataacctatggaaataaaaaattttaaaaaaaaagattatactcataggtgtttcagacccataatagctcgttaatgttcagactggtctctggaaacttgtctctggtttcagtattgataatgaacagaacagtgataatattctagcagtctatacaaatctgtactaatgtttcatctatccattgtctttgggaaatgagttaatgcatgtaagtgaatgttccagataatagaactattctaccaagttttttaacttttttaataaaaaattataaaaagtatttgatatttcctttcttgaacaggatacaaaaaaatagtttaatcagttttgactactcaaggtcatcattgaatagattcattattgtctataccgtaatataaaacatagttatctcctgtttggtttctggtctccttcactgtcaggccgtcacctggctcttcatattactgaagtggtatctgctcctaacagttatttatccgtatttcttttatgttttgctgcttctaatctgctgggtaagcaggtaacaagtttgttaacaatatgtgtttattaagagagtacctaagctctgggtgaatgcctgagtgtgaacataatgcttgtatagggacattctaacagttagatttggtactcaagaggtcttttccttgggttctggtagtcttgcaaagggttgaactcattgaagatcttaagtaccagtaagtatgatatcactgtacttggttttttcactccagtcagtcatattttttggtctacatttagcagaaagcatctgccatatgttc

SEQ ID NO: 2693 - DNA, 1681 bp; single-stranded, linear
ttcagttctagcgtcaacccggtgctctacgtcttcaccgctggagatctgctgccccgggcaggtccccgtttcctcacgcggctcttcgaaggctctggggaggcccgagggggcggccgctctagggaagggaccatggagctccgaactacccctcagctgaaagtggtggggcagggccgcggcaatggagacccggggggtgggatggagaaggacggtccggaatgggacctttgacagcagaccctacaacctgctgcccttccctgtccctttccaccccccacccaccctccagaggtcctcccgacggccatgaacactacatcttctgcagcacccccctcactaggtgtagagttcatctctctgctggctatcatcctgctgtcagtggcgctggctgtggggcttcccggcaacagctttgtggtgtggagtatcctgaaaaggatgcagaagcgctctgtcactgccctgatggtgctgaacctggccctggccgacctggccgtattgctcactgctccctttttccttcacttcctggcccaaggcacctggagttttggactggctggttgccgcctgtgtcactatgtctgcggagtcagcatgtacgccagcgtcctgcttatcacggccatgagtctagaccgctcactggcggtggcccgcccctttgtgtcccagaagctacgcaccaaggcgatggcccggcgggtgctggcaggcatctgggtgttgtcctttctgctggccacacccgtcctcgcgtaccgcacagtagtgccctggaaaacgaacatgagcctgtgcttcccgcggtaccccagcgaagggcaccgggccttccatctaatcttcgaggctgtcacgggcttcctgctgcccttcctggctgtggtggccagctactcggacatagggcgtcggctacaggcccggcgcttccgccgcagccgccgcaccggccgcctggtggtgctcatcatcctgaccttcgccgccttctggctgccctaccacgtggtgaacctggctgaggcgggccgcgcgctggccggccaggccgccgggttagggctcgtggggaagcggctgagcctggcccgcaacgtgctcatcgcactcgccttcctgagcagcagcgtgaaccccgtgctgtacgcgtgcgccggcggcggcctgctgcgctcggcgggcgtgggcttcgtcgccaagctgctggagggcacgggttccgaggcgtccagcacgcgccgcgggggcagcctgggccagaccgctaggagcggccccgccgctctggagcccggcccttccgagagcctcactgcctccagccctctcaagttaaacgaactgaactaggcctggtggaaggaggcgcactttcctcctggcagaatgctagctctgagccagttcagtacctggaggaggagcaggggcgtggagggcgtggagggcgtgggagcgtgggaggcgggagtggagtggaagaagagggagagatggagcaaagtgagggccgagtgagagcgtgctccagcctggctcccacaggcagctttaaccattaaaactgaagtctgaaatttggtcaaaaaaaataaaaaaaaaaaaaaaaaaaaaaaaaaaaaaaaaaaaaaaaaaaaaaaaaaaaaaaaaa

SEQ ID NO: 2694 - DNA, 141589 bp; single-stranded, linear; identical to SEQ ID NO: 2480

SEQ ID NO: 2695 - DNA, 1052 bp; single-stranded, linear
cctctctcggctagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacattcccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacaggtaattaattgttctcttcacttctcatggggcagcacagaaaggaataagttaggtaactgaagtgaccagccctcgaataaaaagtggcttcatggccgggtgtgatggctcacgcctgtaatcccagcactttgggaggccgaggcaggtggatcatttgaggttaggagttcaagaccagcctggccaacatggtgaaacctcgtctcttgaaaaaaaaaaaaaaaaagtggctccaccttttagaacctcttagaagatggcacatttaagccctgcttttttttttttttaaatcccaatatggctctactttggaggacataccagagagtcactagccttttatttccatagagaaaatgaaactatttctcttattctcacacatttgaggttcctttttgagtaagatagatggttctagaaaagaaagaaagatattctacctgaatttccatttgtgtgcagaagtctaaaacactacctttacgatttgtccttgaagaaccccactatctacaacatatctaaagaaaaaaaaaaacagcgaagctgtgcatagcag

SEQ ID NO: 2696 - DNA, 3185 bp; single-stranded, linear
atcaaacagaaatgactattgaaggcttgcagcccacagtggagtatgtggttagtgtctatgctcagaatccaagcggagagagtcagcctctggttcagactgcagtaaccagtacgtaaccactgcttggtttccattttcaaagtcaaattttgttcttgggtgtctgaatgcccacgacatgtcttttgcaattacacatagggaaagtgaacttgttggttagtttatgtcttgagctgagccctttacgaacatcttttttccttctcagtgccaagcgaggaatttacagagaaagaagttgtgaaaccaccatagttagttgctgtgctttgaatttctttttgctcaaatggcctcagcgaaatcttatttgcctatagcaaatctacaaaaaattttcctagaccgtcttttctacaactggatggtaaagttgattgaagtgtgcctcatgtagctttatgtttggggcatttgaagggctatggctggaccagagtgtaatataaatgcttaatagagaggggaaaagaagagtgtaagaaccattatagggctgggctcacgcctgtaatcccagcattttgggaggctgaggcggatcacgaggtcaggagttcgagaccagcctgaccaacatggtgaaaccccatctctactaaaaatacaaaaattagccagtcgcggtggcacgtgcctgtaatcccagctactcacggaggctgaggcagaagaatcacttggacccaggaggcagaagttgcagtgagccaagatcatgcctctgcaccccagcctaggtgatagagtgagactccatctcaaaaaaaaacaaaacaaaacaattataacaatttgaatctgaaccatatgcaaatcagctttaccacttccaaggtataagaaaatccaggtctatgagactaacatcacattgtaaaaatcaaatcgtggtagaatacctttaaattaatataaatacatccccattgtggggacattttgcagggtatctgcttatctcacatacaccatgttttaataagtgatgcaacattgcatattttctaaaccaagaaaaattaagcaagtgtttaagtgatttttcctttgatagtgggttaattggacttcatcaaagaaaatggtatctgcaaaactgctttgcatgttataaaaatgcttatttcacaacttgctttcacataacctcttaccattaatttgcctaacagacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacaggtatatggttaattgcacacaggtgccatgggagcagcggctttatgcctactgaatgaattatgcttcactgggctattgattcccgtgtaagggtgaaaaagaattattaggaaagatcctctttaaagaggaatggtaagaaacaataaaacttaggtgatatttaaggaaacaagtctgattaaaagaaattttggagtatcctggcttatacacaagaccataaagcaagacatttgaagaggatactaaagttgtggattatttcctaagctctgactccctgtgattaccctcactatgtataaagaaaagaagtttggcattacagagcttacttataaaaaggaacccaaactcgggcatttcatagcagcatgattctgagcacacgtgggtaagacctttcttctctggttagatatcatatgctggtgtataattagcttaaatgattgtgatttagacacctaggaaataatcaatagggcaattgctttccataatactttatcttcttgtgctttatttctgaagcagagtagaatgctaaagatgtatcctagtgacagcataaaccctagaggtgacagtctgtattattgcttttcgcttctcttttctgcttctgttgggagccagttttcttcttacgccgcattacagagagaacgtcaaatttagcaagccatatctgccataggtccaaataaagagacaataaaaattattctctcttttttggatggaatactgcgtgaaatggttatccatacaaagatactttatgtagaatagaaaaaggaggccgggtgcagtggctcacacatgtaatcctagtgctttgggaggctaagccgggagcactgattgaggccaggagttcatgatcagcctgggcaatgaagtgagaccccgtctctacaaaaaaatatgaaaaaattagcgaggtgtggtgacacatgcctgtagtcccagctactcaagaggctgaggtagaggatcacttgagcctacgagttcaaggctgcagtgagctatgataactccactgcactgctgcctggatgacacagagagaccgtttctaaattaattaattaacaattttaagaaagaaaaagggccattgcttatttttccatacaaaagtaaaataaatcataatggccaataagccaatgtaacttttttttttaagggaaagcaaaacttgtaaaacctaaaatctcttagagttttggcatttacccaaatgttttcagtgattctgagaattggtggatataaaacacatttctcagcaaacactttcttcattttgcatcccttactgtactttcttgtactgaatctttgcttgaccagggaacccacctagcccaacaagaacaatccattctacttcttggaactacgtttattttccttttcccccatttcctataagataacctctaaccaatgacaatctcgacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaagtcaaccttgctcctgacagctcatccgtggttgtatcaggacttatc

SEQ ID NO: 2697 - DNA, 2823 bp; single-stranded, linear
ctgcacttttgataacctgagtcccggcctggagtacaatgtcagtgtttacactgtcaaggatgacaaggaaagtgtccctatctctgataccatcatcccaggtaatagaaaataagctgctatcctgagagtgacattccaataagagtggggattagcatcttaatccccagatgcttaagggtgtcaactatatttgggatttaattccgatctcccagctgcactttccaaaaccaagaagtcaaagcagcgatttggacaaaatgcttgctgttaacactgctttactgtctgtgcttcactgggatgctgtgtgttgcagcgagtatgtaatggagtggcagccatggctttaactctgtattgtctgctcacatggaagtatgactaaaacactgtcacgtgtctgtactcagtactgataggctcaaagtaatatggtaaatgcatcccatcagtacatttctgcccgattttacaatccatatcaatttccaacagctgcctatttcatcttgcagtttcaaatccttctttttgaaaattggattttaaaaaaaagttaagtaaaagtcacaccttcagggttgttctttcttgtggccttgaaagacaacattgcaaaggcctgtcctaaggataggcttgtttgtccattgggttataacataatgaaagcattggacagatcgtgtccccctttggactcttcagtagaatgcttttactaacgctaattacatgttttgattatgaatgaacctaaaatagtggcaatggccttaacctaggcctgtctttcctcagcctgaatgtgcttttgaatggcacatttcacaccatacattcataatgcattagcgttatggccatgatgttgtcatgagttttgtatgggagaaaaaaaatcaatttatcacccatttattattttttccggttgttcatgcaagcttattttctactaaaacagttttggaattattaaaagcattgctgatacttacttcagatattatgtctaggctctaagaatggtttcgacatcctaaacagccatatgatttttaggaatctgaacagttcaaattgtaccctttaaggatgttttcaaaatgtaaaaaatatatatatatatatatattccctaaaagaatattcctgtttattcttctagggaagcaaactgttcatgatgcttaggaagtcttttcagagaatttaaaacagattgcatattaccatcattgctttaacattccaccaattttactactagtaacctgatatacactgctttattttttcctctttttttccctctattttccttttgcctccccctccctttgctttgtaactcaatagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacgggtgaattttgaaaacttctgcgtttgagacatagatggtgttgcatgctgccaccagttactccggttaaatatggatgtttcatgggggaagtcagcaattggccaaagattcagataggtggaattggggggataaggaatcaaatgcatctgctaaactgattggagaaaaacacatgcaatatcttcagtacactctcatttaaaccacaagtagatataaagcctagagaaatacagatgtctgctctgttaaatataaaatagcaaatgttcattcaatttgaagacctagaatttttcttcttaaataccaaacacgaataccaaattgcgtaagtaccaattgataagaatatatcaccaaaatgtaccatcatgctcttccttctaccctttgataaactctaccatgctccttctttgtagctaaaaacccatcaaaatttagggtagagtggatgggcattgttttgaggtaggagaaaagtaaacttgggaccattctaggttttgttgctgtcactaggtaaagaaacacctctttaaccacagtctggggacaagcatgcaacattttaaaggttctctgctgtgcatgggaaaagaaacatgctgagaaccaatttgcatgaacatgttcacttgtaagtagaattcactgaatggaactgtagctctagatatctcacatggggggaagtttaggaccctcttgtctttttgtctgtgtgcatgtatttctttgtaaagtactgctatgtttctctttgctgtgtggcaacttaagcctcttcggcctgggataaaataatctgcagtggtattaataatgtacataaagtcaacatatttgaaagtagattaaaatcttttttaaatatatcaatgatggcaaaaaggttaaagggggcctaacagtactgtgtgtagtgttttatttttaacagtagtacactataacttaaaatagacttagattagactgtttgcatgattatgattctgtttcctttatgcatgaaatattgattttacctttccagctacttcgttagctttaattttaaaatacattaactgagtcttccttcttgttcgaaaccagctgttcctcctcccactgacctgcgattcaccaacattggtccagacaccatgcgtgtcacctggg

SEQ ID NO: 2698 - DNA, 7680 bp; single-stranded, linear
gaagagcaagaggcaggctcagcaaatggttcagccccagtccccggtggctgtcagtcaaagcaagcccggttgttatgacaatggaaaacactatcagataaatcaacagtgggagcggacctacctaggtaatgtgttggtttgtacttgttatggaggaagccgaggttttaactgcgaaagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggttgaagacacaaggaaataagcaaatgctttgcacgtgcctgggcaacggagtcagctgccaagagacagctgtaacccagacttacggtggcaacttaaatggagagccatgtgtcttaccattcacctacaatggcaggacgttctactcctgcaccacggaagggcgacaggacggacatctttggtgcagcacaacttcgaattatgagcaggaccagaaatactctttctgcacagaccacactgttttggttcagactcaaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcaacttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggccagcccaggcagtacaatgtgggtccctctgtctccaagtaccccctgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccatcgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaca

SEQ ID NO: 2699 - DNA, 14740 bp; single-stranded, linear
cctctctcggctagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacattcccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacaggtaattaattgttctcttcacttctcatggggcagcacagaaaggaataagttaggtaactgaagtgaccagccctcgaataaaaagtggcttcatggccgggtgtgatggctcacgcctgtaatcccagcactttgggaggccgaggcaggtggatcatttgaggttaggagttcaagaccagcctggccaacatggtgaaacctcgtctcttgaaaaaaaaaaaaaaaaagtggctccaccttttagaacctcttagaagatggcacatttaagccctgcttttttttttttttaaatcccaatatggctctactttggaggacataccagagagtcactagccttttatttccatagagaaaatgaaactatttctcttattctcacacatttgaggttcctttttgagtaagatagatggttctagaaaagaaagaaagatattctacctgaatttccatttgtgtgcagaagtctaaaacactacctttacgatttgtccttgaagaaccccactatctacaacatatctaaagaaaaaaaaaaacagcgaagctgtgcatagcagatcaaacagaaatgactattgaaggcttgcagcccacagtggagtatgtggttagtgtctatgctcagaatccaagcggagagagtcagcctctggttcagactgcagtaaccagtacgtaaccactgcttggtttccattttcaaagtcaaattttgttcttgggtgtctgaatgcccacgacatgtcttttgcaattacacatagggaaagtgaacttgttggttagtttatgtcttgagctgagccctttacgaacatcttttttccttctcagtgccaagcgaggaatttacagagaaagaagttgtgaaaccaccatagttagttgctgtgctttgaatttctttttgctcaaatggcctcagcgaaatcttatttgcctatagcaaatctacaaaaaattttcctagaccgtcttttctacaactggatggtaaagttgattgaagtgtgcctcatgtagctttatgtttggggcatttgaagggctatggctggaccagagtgtaatataaatgcttaatagagaggggaaaagaagagtgtaagaaccattatagggctgggctcacgcctgtaatcccagcattttgggaggctgaggcggatcacgaggtcaggagttcgagaccagcctgaccaacatggtgaaaccccatctctactaaaaatacaaaaattagccagtcgcggtggcacgtgcctgtaatcccagctactcacggaggctgaggcagaagaatcacttggacccaggaggcagaagttgcagtgagccaagatcatgcctctgcaccccagcctaggtgatagagtgagactccatctcaaaaaaaaacaaaacaaaacaattataacaatttgaatctgaaccatatgcaaatcagctttaccacttccaaggtataagaaaatccaggtctatgagactaacatcacattgtaaaaatcaaatcgtggtagaatacctttaaattaatataaatacatccccattgtggggacattttgcagggtatctgcttatctcacatacaccatgttttaataagtgatgcaacattgcatattttctaaaccaagaaaaattaagcaagtgtttaagtgatttttcctttgatagtgggttaattggacttcatcaaagaaaatggtatctgcaaaactgctttgcatgttataaaaatgcttatttcacaacttgctttcacataacctcttaccattaatttgcctaacagacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacaggtatatggttaattgcacacaggtgccatgggagcagcggctttatgcctactgaatgaattatgcttcactgggctattgattcccgtgtaagggtgaaaaagaattattaggaaagatcctctttaaagaggaatggtaagaaacaataaaacttaggtgatatttaaggaaacaagtctgattaaaagaaattttggagtatcctggcttatacacaagaccataaagcaagacatttgaagaggatactaaagttgtggattatttcctaagctctgactccctgtgattaccctcactatgtataaagaaaagaagtttggcattacagagcttacttataaaaaggaacccaaactcgggcatttcatagcagcatgattctgagcacacgtgggtaagacctttcttctctggttagatatcatatgctggtgtataattagcttaaatgattgtgatttagacacctaggaaataatcaatagggcaattgctttccataatactttatcttcttgtgctttatttctgaagcagagtagaatgctaaagatgtatcctagtgacagcataaaccctagaggtgacagtctgtattattgcttttcgcttctcttttctgcttctgttgggagccagttttcttcttacgccgcattacagagagaacgtcaaatttagcaagccatatctgccataggtccaaataaagagacaataaaaattattctctcttttttggatggaatactgcgtgaaatggttatccatacaaagatactttatgtagaatagaaaaaggaggccgggtgcagtggctcacacatgtaatcctagtgctttgggaggctaagccgggagcactgattgaggccaggagttcatgatcagcctgggcaatgaagtgagaccccgtctctacaaaaaaatatgaaaaaattagcgaggtgtggtgacacatgcctgtagtcccagctactcaagaggctgaggtagaggatcacttgagcctacgagttcaaggctgcagtgagctatgataactccactgcactgctgcctggatgacacagagagaccgtttctaaattaattaattaacaattttaagaaagaaaaagggccattgcttatttttccatacaaaagtaaaataaatcataatggccaataagccaatgtaacttttttttttaagggaaagcaaaacttgtaaaacctaaaatctcttagagttttggcatttacccaaatgttttcagtgattctgagaattggtggatataaaacacatttctcagcaaacactttcttcattttgcatcccttactgtactttcttgtactgaatctttgcttgaccagggaacccacctagcccaacaagaacaatccattctacttcttggaactacgtttattttccttttcccccatttcctataagataacctctaaccaatgacaatctcgacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaagtcaaccttgctcctgacagctcatccgtggttgtatcaggacttatcctgcacttttgataacctgagtcccggcctggagtacaatgtcagtgtttacactgtcaaggatgacaaggaaagtgtccctatctctgataccatcatcccaggtaatagaaaataagctgctatcctgagagtgacattccaataagagtggggattagcatcttaatccccagatgcttaagggtgtcaactatatttgggatttaattccgatctcccagctgcactttccaaaaccaagaagtcaaagcagcgatttggacaaaatgcttgctgttaacactgctttactgtctgtgcttcactgggatgctgtgtgttgcagcgagtatgtaatggagtggcagccatggctttaactctgtattgtctgctcacatggaagtatgactaaaacactgtcacgtgtctgtactcagtactgataggctcaaagtaatatggtaaatgcatcccatcagtacatttctgcccgattttacaatccatatcaatttccaacagctgcctatttcatcttgcagtttcaaatccttctttttgaaaattggattttaaaaaaaagttaagtaaaagtcacaccttcagggttgttctttcttgtggccttgaaagacaacattgcaaaggcctgtcctaaggataggcttgtttgtccattgggttataacataatgaaagcattggacagatcgtgtccccctttggactcttcagtagaatgcttttactaacgctaattacatgttttgattatgaatgaacctaaaatagtggcaatggccttaacctaggcctgtctttcctcagcctgaatgtgcttttgaatggcacatttcacaccatacattcataatgcattagcgttatggccatgatgttgtcatgagttttgtatgggagaaaaaaaatcaatttatcacccatttattattttttccggttgttcatgcaagcttattttctactaaaacagttttggaattattaaaagcattgctgatacttacttcagatattatgtctaggctctaagaatggtttcgacatcctaaacagccatatgatttttaggaatctgaacagttcaaattgtaccctttaaggatgttttcaaaatgtaaaaaatatatatatatatatatattccctaaaagaatattcctgtttattcttctagggaagcaaactgttcatgatgcttaggaagtcttttcagagaatttaaaacagattgcatattaccatcattgctttaacattccaccaattttactactagtaacctgatatacactgctttattttttcctctttttttccctctattttccttttgcctccccctccctttgctttgtaactcaatagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacgggtgaattttgaaaacttctgcgtttgagacatagatggtgttgcatgctgccaccagttactccggttaaatatggatgtttcatgggggaagtcagcaattggccaaagattcagataggtggaattggggggataaggaatcaaatgcatctgctaaactgattggagaaaaacacatgcaatatcttcagtacactctcatttaaaccacaagtagatataaagcctagagaaatacagatgtctgctctgttaaatataaaatagcaaatgttcattcaatttgaagacctagaatttttcttcttaaataccaaacacgaataccaaattgcgtaagtaccaattgataagaatatatcaccaaaatgtaccatcatgctcttccttctaccctttgataaactctaccatgctccttctttgtagctaaaaacccatcaaaatttagggtagagtggatgggcattgttttgaggtaggagaaaagtaaacttgggaccattctaggttttgttgctgtcactaggtaaagaaacacctctttaaccacagtctggggacaagcatgcaacattttaaaggttctctgctgtgcatgggaaaagaaacatgctgagaaccaatttgcatgaacatgttcacttgtaagtagaattcactgaatggaactgtagctctagatatctcacatggggggaagtttaggaccctcttgtctttttgtctgtgtgcatgtatttctttgtaaagtactgctatgtttctctttgctgtgtggcaacttaagcctcttcggcctgggataaaataatctgcagtggtattaataatgtacataaagtcaacatatttgaaagtagattaaaatcttttttaaatatatcaatgatggcaaaaaggttaaagggggcctaacagtactgtgtgtagtgttttatttttaacagtagtacactataacttaaaatagacttagattagactgtttgcatgattatgattctgtttcctttatgcatgaaatattgattttacctttccagctacttcgttagctttaattttaaaatacattaactgagtcttccttcttgttcgaaaccagctgttcctcctcccactgacctgcgattcaccaacattggtccagacaccatgcgtgtcacctggggaagagcaagaggcaggctcagcaaatggttcagccccagtccccggtggctgtcagtcaaagcaagcccggttgttatgacaatggaaaacactatcagataaatcaacagtgggagcggacctacctaggtaatgtgttggtttgtacttgttatggaggaagccgaggttttaactgcgaaagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggttgaagacacaaggaaataagcaaatgctttgcacgtgcctgggcaacggagtcagctgccaagagacagctgtaacccagacttacggtggcaacttaaatggagagccatgtgtcttaccattcacctacaatggcaggacgttctactcctgcaccacggaagggcgacaggacggacatctttggtgcagcacaacttcgaattatgagcaggaccagaaatactctttctgcacagaccacactgttttggttcagactcaaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcaacttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggccagcccaggcagtacaatgtgggtccctctgtctccaagtaccccctgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccatcgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaca

SEQ ID NO: 2700 - DNA, 2861 bp; single-stranded, linear
ctgctcctgcgcggcagctgctttagaaggtctcgagcctcctgtaccttcccagggatgaaccgggccttccctctggaaggcgagggttcgggccacagtgagcgagggccagggcggtgggcgcgcgcagagggaaaccggatcagttgagagagaatcaagagtagcggatgaggcgcttgtggggcgcggcccggaagccctcgggcgcgggctgggagaaggagtgggcggaggcgccgcaggaggctcccggggcctggtcgggccggctgggccccgggcgcagtggaagaaagggacgggcggtgcccggttgggcgtcctggccagctcaccttgccctggcggctcgccccgcccggcacttgggaggagcagggcagggcccgcggcctttgcattctgggaccgcccccttccattcccgggccagcggcgagcggcagcgacggctggagccgcagctacagcatgagagccggtgccgctcctccacgcctgcggacgcgtggcgagcggaggcagcgctgcctgttcgcgccatgggggcaccgtggggctcgccgacggcggcggcgggcgggcggcgcgggtggcgccgaggccgggggctgccatggaccgtctgtgtgctggcggccgccggcttgacgtgtacggcgctgatcacctacgcttgctgggggcagctgccgccgctgccctgggcgtcgccaaccccgtcgcgaccggtgggcgtgctgctgtggtgggagcccttcggggggcgcgatagcgccccgaggccgccccctgactgccggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggcggcggcagaagccctggcgacctccagccccaggcccccgggccagcgctgggtttggatgaacttcgagtcgccctcgcactccccggggctgcgaagcctggcaagtaacctcttcaactggacgctctcctaccgggcggactcggacgtctttgtgccttatggctacctctaccccagaagccaccccggcgacccgccctcaggcctggccccgccactgtccaggaaacaggggctggtggcatgggtggtgagccactgggacgagcgccaggcccgggtccgctactaccaccaactgagccaacatgtgaccgtggacgtgttcggccggggcgggccggggcagccggtgcccgaaattgggctcctgcacacagtggcccgctacaagttctacctggctttcgagaactcgcagcacctggattatatcaccgagaagctctggcgcaacgcgttgctcgctggggcggtgccggtggtgctgggcccagaccgtgccaactacgagcgctttgtgccccgcggcgccttcatccacgtggacgacttcccaagtgcctcctccctggcctcgtacctgcttttcctcgaccgcaaccccgcggtctatcgccgctacttccactggcgccggagctacgctgtccacatcacctccttctgggacgagccttggtgccgggtgtgccaggctgtacagagggctggggaccggcccaagagcatacggaacttggccagctggttcgagcggtgaagccgcgctcccctggaagcgacccaggggaggccaagttgtcagctttttgatcctctactgtgcatctccttgactgccgcatcatgggagtaagttcttcaaacacccatttttgctctatgggaaaaaaacgatttaccaattaatattactcagcacagagatgggggcccggtttccatattttttgcacagctagcaattgggctccctttgctgctgatgggcatcattgtttaggggtgaaggagggggttcttcctcaccttgtaaccagtgcagaaatgaaatagcttagcggcaagaagccgttgaggcggtttcctgaatttccccatctgccacaggccatatttgtggcccgtgcagcttccaaatctcatacacaactgttcccgattcacgtttttctggaccaaggtgaagcaaatttgtggttgtagaaggagccttgttggtggagagtggaaggactgtggctgcaggtgggactttgttgtttggattcctcacagccttggctcctgagaaaggtgaggagggcagtccaagaggggccgctgacttctttcacaagtactatctgttcccctgtcctgtgaatggaagcaaagtgctggattgtccttggaggaaacttaagatgaatacatgcgtgtacctcactttacataagaaatgtattcctgaaaagctgcatttaaatcaagtcccaaattcattgacttaggggagttcagtatttaatgaaaccctatggagaatttatccctttacaatgtgaatagtcatctcctaatttgtttcttctgtctttatgtttttctataacctggattttttaaatcatattaaaattacagatgtgaaaataaagcagaagcaacctttttccctcttcccagaaaaccagtctgtgtttacagacagaagagaaggaagccatagtgtcacttccacacaattatttatttcatgtctttactggacctgaaatttaaactgcaatgccagtcctgcaggagtgctggcattaccctctgcagaacagtgaaaggtattgcactacattatggaatcatgcaaaaaaaa

SEQ ID NO: 2701 - DNA, 1256 bp; single-stranded, linear
acgcgtggcgagcggaggcagcgctgcctgttcgcgccatgggggcaccgtggggctcgccgacggcggcggcgggcgggcggcgcgggtggcgccgaggccgggggctgccatggaccgtctgtgtgctggcggccgccggcttgacgtgtacggcgctgatcacctacgcttgctgggggcagctgccgccgctgccctgggcgtcgccaaccccgtcgcgaccggtgggcgtgctgctgtggtgggagcccttcggggggcgcgatagcgccccgaggccgccccctgactgcccgctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggcggcggcagaagccctggcgacctccagccccaggcccccgggccagcgctgggtttggatgaacttcgagtcgccctcgcactccccggggctgcgaagcctggcaagtaacctcttcaactggacgctctcctaccgggcggactcggacgtctttgtgccttatggctacctctaccccagaagccaccccggcgacccgccctcaggcctggccccgccactgtccaggaaacaggggctggtggcatgggtggtgagccactgggacgagcgccaggcccgggtccgctactaccaccaactgagccaacatgtgaccgtggacgtgttcggccggggcgggccggggcagccggtgcccgaaattgggctcctgcacacagtggcccgctacaagttctacctggctttcgagaactcgcagcacctggattatatcaccgagaagctctggcgcaacgcgttgctcgctggggcggtgccggtggtgctgggcccagaccgtgccaactacgagcgctttgtgccccgcggcgccttcatccacgtggacgacttcccaagtgcctcctccctggcctcgtacctgcttttcctcgaccgcaaccccgcggtctatcgccgctacttccactggcgccggagctacgctgtccacatcacctccttctgggacgagccttggtgccgggtgtgccaggctgtacagagggctggggaccggcccaagagcatacggaacttggccagctggttcgagcggtag

SEQ ID NO: 2702 - DNA, 1126 bp; single-stranded, linear
cagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccgcccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggcccggcatggggcctgggctgccaggg

SEQ ID NO: 2703 - DNA, 1701 bp; single-stranded, linear
aaggagcacagttccaggcggggctgagctagggcgtagctgtgatttcaggggcacctctggcggctgccgtgatttgagaatctcgggtctcttggctgactgatcctgggagactgtggatgaataatgctgggcacggccccacccggaggctgcgaggcttgggggtcctggccggggtggctctgctcgctgccctctggctcctgtggctgctggggtcagcccctcggggtaccccggcaccccagcccacgatcaccatccttgtctggcactggcccttcactgaccagcccccagagctgcccagcgacacctgcacccgctacggcatcgcccgctgccacctgagtgccaaccgaagcctgctggccagcgccgacgccgtggtcttccaccaccgcgagctgcagacccggcggtcccacctgcccctggcccagcggccgcgagggcagccctgggtgtgggcctccatggagtctcctagccacacccacggcctcagccacctccgaggcatcttcaactgggtgctgagctaccggcgcgactcggacatctttgtgccctatggccgcctggagccccactgggggccctcgccaccgctgccagccaagagcagggtggccgcctgggtggtcagcaacttccaggagcggcagctgcgtgccaggctgtaccggcagctggcgcctcatctgcgggtggatgtctttggccgtgccaatggacggccactgtgcgccagctgcctggtgcccaccgtggcccagtaccgcttctacctgtcctttgagaactctcagcaccgcgactacattacggagaaattctggcgcaacgcactggtggctggcactgtgccagtggtgctggggcccccacgggccacctatgaggccttcgtgccggctgacgccttcgtgcatgtggatgactttggctcagcccgagagctggcggctttcctcactggcatgaatgagagccgataccaacgcttctttgcctggcgtgacaggctccgcgtgcgactgttcaccgactggcgggaacgtttctgtgccatctgtgaccgctacccacacctaccccgcagccaagtctatgaggaccttgagggttggtttcaggcctgagatccgctggccgggggaggtgggtgtgggtggaagggctgggtgtcgaaatcaaaccaccaggcatccggcccttaccggcaagcagcgggctaacgggaggctgggcacagaggtcaggaagcaggggtggggggtgcaggtgggcactggagcatgcagaggaggtgagagtgggagggaggtaacgggtgcctgctgcggcagacgggaggggaaaggctgccgaggaccctccccaccctgaacaaatcttgggtgggtgaaggcctggctggaagagggtgaaaggcagggcccttggggctggggggcaccccagcctgaagtttgtgggggccaaacctgggaccccgagcttcctcggtagcagaggccctgtggtccccgagacacaggcacgggtccctgccacgtccatagttctgaggtccctgtgtgtaggctggggcggggcccaggagaccacggggagcaaaccagcttgttctgggctcagggagggagggcggtggacaataaacgtctgagcagtgaaaaaaaaaaaaaa

SEQ ID NO: 2704 - DNA, 6944 bp; single-stranded, linear
ctgctcctgcgcggcagctgctttagaaggtctcgagcctcctgtaccttcccagggatgaaccgggccttccctctggaaggcgagggttcgggccacagtgagcgagggccagggcggtgggcgcgcgcagagggaaaccggatcagttgagagagaatcaagagtagcggatgaggcgcttgtggggcgcggcccggaagccctcgggcgcgggctgggagaaggagtgggcggaggcgccgcaggaggctcccggggcctggtcgggccggctgggccccgggcgcagtggaagaaagggacgggcggtgcccggttgggcgtcctggccagctcaccttgccctggcggctcgccccgcccggcacttgggaggagcagggcagggcccgcggcctttgcattctgggaccgcccccttccattcccgggccagcggcgagcggcagcgacggctggagccgcagctacagcatgagagccggtgccgctcctccacgcctgcggacgcgtggcgagcggaggcagcgctgcctgttcgcgccatgggggcaccgtggggctcgccgacggcggcggcgggcgggcggcgcgggtggcgccgaggccgggggctgccatggaccgtctgtgtgctggcggccgccggcttgacgtgtacggcgctgatcacctacgcttgctgggggcagctgccgccgctgccctgggcgtcgccaaccccgtcgcgaccggtgggcgtgctgctgtggtgggagcccttcggggggcgcgatagcgccccgaggccgccccctgactgccggctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggcggcggcagaagccctggcgacctccagccccaggcccccgggccagcgctgggtttggatgaacttcgagtcgccctcgcactccccggggctgcgaagcctggcaagtaacctcttcaactggacgctctcctaccgggcggactcggacgtctttgtgccttatggctacctctaccccagaagccaccccggcgacccgccctcaggcctggccccgccactgtccaggaaacaggggctggtggcatgggtggtgagccactgggacgagcgccaggcccgggtccgctactaccaccaactgagccaacatgtgaccgtggacgtgttcggccggggcgggccggggcagccggtgcccgaaattgggctcctgcacacagtggcccgctacaagttctacctggctttcgagaactcgcagcacctggattatatcaccgagaagctctggcgcaacgcgttgctcgctggggcggtgccggtggtgctgggcccagaccgtgccaactacgagcgctttgtgccccgcggcgccttcatccacgtggacgacttcccaagtgcctcctccctggcctcgtacctgcttttcctcgaccgcaaccccgcggtctatcgccgctacttccactggcgccggagctacgctgtccacatcacctccttctgggacgagccttggtgccgggtgtgccaggctgtacagagggctggggaccggcccaagagcatacggaacttggccagctggttcgagcggtgaagccgcgctcccctggaagcgacccaggggaggccaagttgtcagctttttgatcctctactgtgcatctccttgactgccgcatcatgggagtaagttcttcaaacacccatttttgctctatgggaaaaaaacgatttaccaattaatattactcagcacagagatgggggcccggtttccatattttttgcacagctagcaattgggctccctttgctgctgatgggcatcattgtttaggggtgaaggagggggttcttcctcaccttgtaaccagtgcagaaatgaaatagcttagcggcaagaagccgttgaggcggtttcctgaatttccccatctgccacaggccatatttgtggcccgtgcagcttccaaatctcatacacaactgttcccgattcacgtttttctggaccaaggtgaagcaaatttgtggttgtagaaggagccttgttggtggagagtggaaggactgtggctgcaggtgggactttgttgtttggattcctcacagccttggctcctgagaaaggtgaggagggcagtccaagaggggccgctgacttctttcacaagtactatctgttcccctgtcctgtgaatggaagcaaagtgctggattgtccttggaggaaacttaagatgaatacatgcgtgtacctcactttacataagaaatgtattcctgaaaagctgcatttaaatcaagtcccaaattcattgacttaggggagttcagtatttaatgaaaccctatggagaatttatccctttacaatgtgaatagtcatctcctaatttgtttcttctgtctttatgtttttctataacctggattttttaaatcatattaaaattacagatgtgaaaataaagcagaagcaacctttttccctcttcccagaaaaccagtctgtgtttacagacagaagagaaggaagccatagtgtcacttccacacaattatttatttcatgtctttactggacctgaaatttaaactgcaatgccagtcctgcaggagtgctggcattaccctctgcagaacagtgaaaggtattgcactacattatggaatcatgcaaaaaaaaacgcgtggcgagcggaggcagcgctgcctgttcgcgccatgggggcaccgtggggctcgccgacggcggcggcgggcgggcggcgcgggtggcgccgaggccgggggctgccatggaccgtctgtgtgctggcggccgccggcttgacgtgtacggcgctgatcacctacgcttgctgggggcagctgccgccgctgccctgggcgtcgccaaccccgtcgcgaccggtgggcgtgctgctgtggtgggagcccttcggggggcgcgatagcgccccgaggccgccccctgactgcccgctgcgcttcaacatcagcggctgccgcctgctcaccgaccgcgcgtcctacggagaggctcaggccgtgcttttccaccaccgcgacctcgtgaaggggccccccgactggcccccgccctggggcatccaggcgcacactgccgaggaggtggatctgcgcgtgttggactacgaggaggcagcggcggcggcagaagccctggcgacctccagccccaggcccccgggccagcgctgggtttggatgaacttcgagtcgccctcgcactccccggggctgcgaagcctggcaagtaacctcttcaactggacgctctcctaccgggcggactcggacgtctttgtgccttatggctacctctaccccagaagccaccccggcgacccgccctcaggcctggccccgccactgtccaggaaacaggggctggtggcatgggtggtgagccactgggacgagcgccaggcccgggtccgctactaccaccaactgagccaacatgtgaccgtggacgtgttcggccggggcgggccggggcagccggtgcccgaaattgggctcctgcacacagtggcccgctacaagttctacctggctttcgagaactcgcagcacctggattatatcaccgagaagctctggcgcaacgcgttgctcgctggggcggtgccggtggtgctgggcccagaccgtgccaactacgagcgctttgtgccccgcggcgccttcatccacgtggacgacttcccaagtgcctcctccctggcctcgtacctgcttttcctcgaccgcaaccccgcggtctatcgccgctacttccactggcgccggagctacgctgtccacatcacctccttctgggacgagccttggtgccgggtgtgccaggctgtacagagggctggggaccggcccaagagcatacggaacttggccagctggttcgagcggtagcagatactctgacccatggatcccctgggcccggccaagccacagtggtcgtggcgctgctgtctgaccacgctgctgtttcagctgctgatggctgtgtgtttcttctcctatctgcgtgtgtctcaagacgatcccactgtgtaccctaatgggtcccgcttcccagacagcacagggacccccgcccactccatccccctgatcctgctgtggacgtggccttttaacaaacccatagctctgccccgctgctcagagatggtgcctggcacggctgactgcaacatcactgccgaccgcaaggtgtatccacaggcagacgcggtcatcgtgcaccaccgagaggtcatgtacaaccccagtgcccagctcccacgctccccgaggcggcaggggcagcgatggatctggttcagcatggagtccccaagccactgctggcagctgaaagccatggacggatacttcaatctcaccatgtcctaccgcagcgactccgacatcttcacgccctacggctggctggagccgtggtccggccagcctgcccacccaccgctcaacctctcggccaagaccgagctggtggcctgggcagtgtccaactgggggccaaactccgccagggtgcgctactaccagagcctgcaggcccatctcaaggtggacgtgtacggacgctcccacaagcccctgccccagggaaccatgatggagacgctgtcccggtacaagttctatctggccttcgagaactccttgcaccccgactacatcaccgagaagctgtggaggaacgccctggaggcctgggccgtgcccgtggtgctgggccccagcagaagcaactacgagaggttcctgccgcccgacgccttcatccacgtggacgacttccagagccccaaggacctggcccggtacctgcaggagctggacaaggaccacgcccgctacctgagctactttcgctggcgggagacgctgcggcctcgctccttcagctgggcactcgctttctgcaaggcctgctggaaactgcaggaggaatccaggtaccagacacgcggcatagcggcttggttcacctgagaggcccggcatggggcctgggctgccagggaaggagcacagttccaggcggggctgagctagggcgtagctgtgatttcaggggcacctctggcggctgccgtgatttgagaatctcgggtctcttggctgactgatcctgggagactgtggatgaataatgctgggcacggccccacccggaggctgcgaggcttgggggtcctggccggggtggctctgctcgctgccctctggctcctgtggctgctggggtcagcccctcggggtaccccggcaccccagcccacgatcaccatccttgtctggcactggcccttcactgaccagcccccagagctgcccagcgacacctgcacccgctacggcatcgcccgctgccacctgagtgccaaccgaagcctgctggccagcgccgacgccgtggtcttccaccaccgcgagctgcagacccggcggtcccacctgcccctggcccagcggccgcgagggcagccctgggtgtgggcctccatggagtctcctagccacacccacggcctcagccacctccgaggcatcttcaactgggtgctgagctaccggcgcgactcggacatctttgtgccctatggccgcctggagccccactgggggccctcgccaccgctgccagccaagagcagggtggccgcctgggtggtcagcaacttccaggagcggcagctgcgtgccaggctgtaccggcagctggcgcctcatctgcgggtggatgtctttggccgtgccaatggacggccactgtgcgccagctgcctggtgcccaccgtggcccagtaccgcttctacctgtcctttgagaactctcagcaccgcgactacattacggagaaattctggcgcaacgcactggtggctggcactgtgccagtggtgctggggcccccacgggccacctatgaggccttcgtgccggctgacgccttcgtgcatgtggatgactttggctcagcccgagagctggcggctttcctcactggcatgaatgagagccgataccaacgcttctttgcctggcgtgacaggctccgcgtgcgactgttcaccgactggcgggaacgtttctgtgccatctgtgaccgctacccacacctaccccgcagccaagtctatgaggaccttgagggttggtttcaggcctgagatccgctggccgggggaggtgggtgtgggtggaagggctgggtgtcgaaatcaaaccaccaggcatccggcccttaccggcaagcagcgggctaacgggaggctgggcacagaggtcaggaagcaggggtggggggtgcaggtgggcactggagcatgcagaggaggtgagagtgggagggaggtaacgggtgcctgctgcggcagacgggaggggaaaggctgccgaggaccctccccaccctgaacaaatcttgggtgggtgaaggcctggctggaagagggtgaaaggcagggcccttggggctggggggcaccccagcctgaagtttgtgggggccaaacctgggaccccgagcttcctcggtagcagaggccctgtggtccccgagacacaggcacgggtccctgccacgtccatagttctgaggtccctgtgtgtaggctggggcggggcccaggagaccacggggagcaaaccagcttgttctgggctcagggagggagggcggtggacaataaacgtctgagcagtgaaaaaaaaaaaaaa

SEQ ID NO: 2705 - DNA, 2025 bp; single-stranded, linear
cccccctccaagataatttttaaaaaaccttctcctttgctcacctttgcttcccagccttcccatccccccaccgaaagcaaatcattcaacgacccccgaccctccgacggcaggagccccccgacctcccaggcggaccgccctccctccccggggttccgggcccggcgagagggcgcgagcacagccgaggccatggaggtgacggcggaccagccgcgctgggtgagccaccaccaccccgccgtgctcaacgggcagcacccggacacgcaccacccgggcctcagccactcctacatggacgcggcgcagtacccgctgccggaggaggtggatgtgctttttaacatcgacggtcaaggcaaccacgtcccgccctactacggaaactcggtcagggccacggtgcagaggtaccctccgacccaccacgggagccaggtgtgccgcccgcctctgcttcatggatccctaccctggctggacggcggcaaagccctgggcagccaccacaccgcctccccctggaatctcagccccttctccaagacgtccatccaccacggctccccggggcccctctccgtctaccccccggcctcgtcctcctccttgtcggggggccacgccagcccgcacctcttcaccttcccgcccaccccgccgaaggacgtctccccggacccatcgctgtccaccccaggctcggccggctcggcccggcaggacgagaaagagtgcctcaagtaccaggtgcccctgcccgacagcatgaagctggagtcgtcccactcccgtggcagcatgaccgccctgggtggagcctcctcgtcgacccaccaccccatcaccacctacccgccctacgtgcccgagtacagctccggactcttcccccccagcagcctgctgggcggctcccccaccggcttcggatgcaagtccaggcccaaggcccggtccagcacagaaggcagggagtgtgtgaactgtggggcaacctcgaccccactgtggcggcgagatggcacgggacactacctgtgcaacgcctgcgggctctatcacaaaatgaacggacagaaccggcccctcattaagcccaagcgaaggctgtctgcagccaggagagcagggacgtcctgtgcgaactgtcagaccaccacaaccacactctggaggaggaatgccaatggggaccctgtctgcaatgcctgtgggctctactacaagcttcacaatattaacagacccctgactatgaagaaggaaggcatccagaccagaaaccgaaaaatgtctagcaaatccaaaaagtgcaaaaaagtgcatgactcactggaggacttccccaagaacagctcgtttaacccggccgccctctccagacacatgtcctccctgagccacatctcgcccttcagccactccagccacatgctgaccacgcccacgccgatgcacccgccatccagcctgtcctttggaccacaccacccctccagcatggtcaccgccatgggttagagccctgctcgatgctcacagggcccccagcgagagtccctgcagtccctttcgacttgcatttttgcaggagcagtatcatgaagcctaaacgcgatggatatatgtttttgaaggcagaaagcaaaattatgtttgccactttgcaaaggagctcactgtggtgtctgtgttccaaccactgaatctggaccccatctgtgaataagccattctgactcatatcccctatttaacagggtctctagtgctgtgaaaaaaaaaatgctgaacattgcatataacttatattgtaagaaatactgtacaatgactttattgcatctgggtagctgtaaggcatgaaggatgccaagaagtttaaggaatatgggagaaatggtgtggaaattaagaagaaactaggtctgatattcaaatggacaaactgccagttttgtttcctttcactggccacagttgtttgatgcattaaaagaaaataaaaaaaag

SEQ ID NO: 2706 - DNA, 789 bp; single-stranded, linear
acacagagagaaaggctaaagttctctggaggatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtgagaccggccagatgaggctggccaagccggggagctgctctctcatgaaacaagagctagaaactcaggatggtcatcttggagggaccaaggggtgggccacagccatggtgggagtggcctggacctgccctgggcacactgaccctgatacaggcatggcagaagaatgggaatattttatactgacagaaatcagtaatatttatatatttatatttttaaaatatttatttatttatttatttaagttcatattccatatttattcaagatgttttaccgtaataattattattaaaaatagcttctaaaaaaaaaaa

SEQ ID NO: 2707 - DNA, 1283 bp; single-stranded, linear
ttctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccag

SEQ ID NO: 2708 - DNA, 3043 bp; single-stranded, linear
ttctcagagtggctgcagtctcgctgctggatgtgcacatggtggtcattccctctgctcacaggggcaggggtccccccttactggactgaggttgccccctgctccaggtcctgggtgggagcccatgtgaactgtcagtggggcaggtctgtgagagctcccctcacactcaagtctctctcacagtggccagagaagaggaaggctggagtcagaatgaggcaccagggcgggcatagcctgcccaaaggcccctgggattacaggcaggatggggagccctatctaagtgtctcccacgccccaccccagccattccaggccaggaagtccaaactgtgcccctcagagggagggggcagcctcaggcccattcagactgcccagggagggctggagagccctcaggaaggcgggtgggtgggctgtcggttcttggaaaggttcattaatgaaaacccccaagcctgaccacctagggaaaaggctcaccgttcccatgtgtggctgataagggccaggagattccacagttcaggtagttcccccgcctccctggcattttgtggtcaccattaatcatttcctctgtgtatttaagagctcttttgccagtgagcccagctacacagagagaaaggctaaagttctctggaggatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatggtaagtgagagaatgtgggcctgtgctaggcaccagtggccctgactggccacgcctgtcagcttgataacatgacattttccttttctacagaatgaaacagtagaagtcatctcagaaatgtttgacctccaggtaagatgcttctctctgacatagctttccagaagcccctgccctggggtggaggtggggactccattttagatggcaccacacagggttgtccactttctctccagtcagctggctgcaggaggagggggtagcaactgggtgctcaagaggctgctggccgtgcccctatggcagtcacatgagctcctttatcagctgagcggccatgggcagacctagcattcaatggccaggagtcaccaggggacaggtggtaaagtgggggtcacttcatgagacaggagctgtgggtttggggcgctcactgtgccccgagaccaagtcctgttgagacagtgctgactacagagaggcacagaggggtttcaggaacaacccttgcccacccagcaggtccaggtgaggccccacccccctctccctgaatgatggggtgagagtcacctccttccctaaggctgggctcctctccaggtgccgctgagggtggcctgggcggggcagtgagaagggcaggttcgtgcctgccatggacagggcagggtctatgactggacccagcctgtgcccctcccaagccctactcctgggggctgggggcagcagcaaaaaggagtggtggagagttcttgtaccactgtgggcacttggccactgctcaccgacgaacgacattttccacaggagccgacctgcctacagacccgcctggagctgtacaagcagggcctgcggggcagcctcaccaagctcaagggccccttgaccatgatggccagccactacaagcagcactgccctccaaccccggtgagtgcctacggcagggcctccagcaggaatgtcttaatctagggggtggggtcgacatggggagagatctatggctgtggctgttcaggaccccagggggtttctgtgccaacagttatgtaatgattagccctccagagaggaggcagacagcccatttcatcccaaggagtcagagccacagagcgctgaagcccacagtgctccccagcaggagctgctcctatcctggtcattattgtcattacggttaatgaggtcagaggtgagggcaaacccaaggaaacttggggcctgcccaaggcccagaggaagtgcccaggcccaagtgccaccttctggcaggactttcctctggccccacatggggtgcttgaattgcagaggatcaaggaagggaggctacttggaatggacaaggacctcaggcactccttcctgcgggaagggagcaaagtttgtggccttgactccactccttctgggtgcccagagacgacctcagcccagctgccctgctctgccctgggaccaaaaaggcaggcgtttgactgcccagaaggccaacctcaggctggcacttaagtcaggcccttgactctggctgccactggcagagctatgcactccttggggaacacgtgggtggcagcagcgtcacctgacccaggtcagtgggtgtgtcctggagtgggcctcctggcctctgagttctaagaggcagtagagaaacatgctggtgcttccttcccccacgttacccacttgcctggactcaagtgttttttatttttctttttttaaaggaaacttcctgtgcaacccagattatcacctttgaaagtttcaaagagaacctgaaggactttctgcttgtcatcccctttgactgctgggagccagtccaggagtgagaccggccagatgaggctggccaagccggggagctgctctctcatgaaacaagagctagaaactcaggatggtcatcttggagggaccaaggggtgggccacagccatggtgggagtggcctggacctgccctgggcacactgaccctgatacaggcatggcagaagaatgggaatattttatactgacagaaatcagtaatatttatatatttatatttttaaaatatttatttatttatttatttaagttcatattccatatttattcaagatgttttaccgtaataattattattaaaaatatgcttctacttgtccagtgttctagtttgtttttaaccatgagcaaatgccat

SEQ ID NO: 2709 - DNA, 5115 bp; single-stranded, linear
acacagagagaaaggctaaagttctctggaggatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatgaatgaaacagtagaagtcatctcagaaatgtttgacctccaggagccgacctgcctacagacccgcctggagctgtacaagcagggcctgcggggcagcctcaccaagctcaagggccccttgaccatgatggccagccactacaagcagcactgccctccaaccccggaaacttcctgtgcaacccagattatcacctttgaaagtttcaaagagaacctgaaggactttctgcttgtcatcccctttgactgctgggagccagtccaggagtgagaccggccagatgaggctggccaagccggggagctgctctctcatgaaacaagagctagaaactcaggatggtcatcttggagggaccaaggggtgggccacagccatggtgggagtggcctggacctgccctgggcacactgaccctgatacaggcatggcagaagaatgggaatattttatactgacagaaatcagtaatatttatatatttatatttttaaaatatttatttatttatttatttaagttcatattccatatttattcaagatgttttaccgtaataattattattaaaaatagcttctaaaaaaaaaaattctctctgaccagcaccatgcttctcctggtgacaagccttctgctctgtgagttaccacacccagcattcctcctgatcccagagaaatcggatctgcgaacagtggcaccagcctctagtctcaatgtgaggtttgactccaggacgatgaatttaagctgggactgccaagaaaacacaaccttcagcaagtgtttcttaactgacaagaagaacagagtcgtggaacccaggctcagtaacaacgaatgttcgtgcacatttcgtgaaatttgtctgcatgaaggagtcacatttgaggttcacgtgaatactagtcaaagaggatttcaacagaaactgctttatccaaattcaggaagggagggtaccgctgctcagaatttctcctgtttcatctacaatgcggatttaatgaactgtacctgggcgaggggtccgacggccccccgtgacgtccagtattttttgtacatacgaaactcaaagagaaggagggagatccggtgtccttattacatacaagactcaggaacccatgtgggatgtcacctggataacctgtcaggattaacgtctcgcaattactttctggttaacggaaccagccgagaaattggcatccaattctttgattcacttttggacacaaagaaaatagaacgattcaaccctcccagcaatgtcaccgtacgttgcaacacgacgcactgcctcgtacggtggaaacagcccaggacctatcagaagctgtcgtacctggactttcagtaccagctggacgtccacagaaagaatacccagcctggcacggaaaacctactgattaatgtttctggtgatttggaaaatagatacaactttccaagctctgagcccagagcaaaacacagtgtgaagatcagagctgcagacgtccgcatcttgaattggagctcctggagtgaagccattgaatttggttccttaggatacagcggctgttcccgccagttccacagatcaaagacaaactgaatgataaccatgaggtggaagacgagatcatctgggaggaattcaccccagaggaagggaaaggctaccgcgaagaggtcttgaccgtgaaggaaattacctgagacccagagggtgtaggaatggcatggacatctccgcctccgcgacacgggggaactgttttcttgatgatgctgtgaacctttatatcattttctatgtttttatttaaaaacatgacatttggggccaggcgcggtggctcacgcctgtaatcccagttctcagagtggctgcagtctcgctgctggatgtgcacatggtggtcattccctctgctcacaggggcaggggtccccccttactggactgaggttgccccctgctccaggtcctgggtgggagcccatgtgaactgtcagtggggcaggtctgtgagagctcccctcacactcaagtctctctcacagtggccagagaagaggaaggctggagtcagaatgaggcaccagggcgggcatagcctgcccaaaggcccctgggattacaggcaggatggggagccctatctaagtgtctcccacgccccaccccagccattccaggccaggaagtccaaactgtgcccctcagagggagggggcagcctcaggcccattcagactgcccagggagggctggagagccctcaggaaggcgggtgggtgggctgtcggttcttggaaaggttcattaatgaaaacccccaagcctgaccacctagggaaaaggctcaccgttcccatgtgtggctgataagggccaggagattccacagttcaggtagttcccccgcctccctggcattttgtggtcaccattaatcatttcctctgtgtatttaagagctcttttgccagtgagcccagctacacagagagaaaggctaaagttctctggaggatgtggctgcagagcctgctgctcttgggcactgtggcctgcagcatctctgcacccgcccgctcgcccagccccagcacgcagccctgggagcatgtgaatgccatccaggaggcccggcgtctcctgaacctgagtagagacactgctgctgagatggtaagtgagagaatgtgggcctgtgctaggcaccagtggccctgactggccacgcctgtcagcttgataacatgacattttccttttctacagaatgaaacagtagaagtcatctcagaaatgtttgacctccaggtaagatgcttctctctgacatagctttccagaagcccctgccctggggtggaggtggggactccattttagatggcaccacacagggttgtccactttctctccagtcagctggctgcaggaggagggggtagcaactgggtgctcaagaggctgctggccgtgcccctatggcagtcacatgagctcctttatcagctgagcggccatgggcagacctagcattcaatggccaggagtcaccaggggacaggtggtaaagtgggggtcacttcatgagacaggagctgtgggtttggggcgctcactgtgccccgagaccaagtcctgttgagacagtgctgactacagagaggcacagaggggtttcaggaacaacccttgcccacccagcaggtccaggtgaggccccacccccctctccctgaatgatggggtgagagtcacctccttccctaaggctgggctcctctccaggtgccgctgagggtggcctgggcggggcagtgagaagggcaggttcgtgcctgccatggacagggcagggtctatgactggacccagcctgtgcccctcccaagccctactcctgggggctgggggcagcagcaaaaaggagtggtggagagttcttgtaccactgtgggcacttggccactgctcaccgacgaacgacattttccacaggagccgacctgcctacagacccgcctggagctgtacaagcagggcctgcggggcagcctcaccaagctcaagggccccttgaccatgatggccagccactacaagcagcactgccctccaaccccggtgagtgcctacggcagggcctccagcaggaatgtcttaatctagggggtggggtcgacatggggagagatctatggctgtggctgttcaggaccccagggggtttctgtgccaacagttatgtaatgattagccctccagagaggaggcagacagcccatttcatcccaaggagtcagagccacagagcgctgaagcccacagtgctccccagcaggagctgctcctatcctggtcattattgtcattacggttaatgaggtcagaggtgagggcaaacccaaggaaacttggggcctgcccaaggcccagaggaagtgcccaggcccaagtgccaccttctggcaggactttcctctggccccacatggggtgcttgaattgcagaggatcaaggaagggaggctacttggaatggacaaggacctcaggcactccttcctgcgggaagggagcaaagtttgtggccttgactccactccttctgggtgcccagagacgacctcagcccagctgccctgctctgccctgggaccaaaaaggcaggcgtttgactgcccagaaggccaacctcaggctggcacttaagtcaggcccttgactctggctgccactggcagagctatgcactccttggggaacacgtgggtggcagcagcgtcacctgacccaggtcagtgggtgtgtcctggagtgggcctcctggcctctgagttctaagaggcagtagagaaacatgctggtgcttccttcccccacgttacccacttgcctggactcaagtgttttttatttttctttttttaaaggaaacttcctgtgcaacccagattatcacctttgaaagtttcaaagagaacctgaaggactttctgcttgtcatcccctttgactgctgggagccagtccaggagtgagaccggccagatgaggctggccaagccggggagctgctctctcatgaaacaagagctagaaactcaggatggtcatcttggagggaccaaggggtgggccacagccatggtgggagtggcctggacctgccctgggcacactgaccctgatacaggcatggcagaagaatgggaatattttatactgacagaaatcagtaatatttatatatttatatttttaaaatatttatttatttatttatttaagttcatattccatatttattcaagatgttttaccgtaataattattattaaaaatatgcttctacttgtccagtgttctagtttgtttttaaccatgagcaaatgccat

SEQ ID NO: 2710 - DNA, 2440 bp; single-stranded, linear
atcctggctgatatggtgaaaccccatctctactaaaaatacaaaaattagctgggcgtggtggtgggcgcatgtaatcccagctactcaggaggctgaggcaggagaattacttgaacctgggaggcagaggttgcagtgaaccgagatcgcgccattgcactccagtctggcgacagagcgagactccgtctctaaataaataaataaataaatttagccttctactcaagaacttatctggctttgtcttaatgtaaaaataatttctttttgctaaattattgagagaaatttactatttattagtgtttatcagttttctttaaactcaccactttttgatgaatatgaaaatctaaaaacttggccgggcgcagtggctcacacctgtaatctcagcactttgggaggccaaggtgggcggatcatctgaggtcaggagttcaagatcagcctgaccaacatggtgaaaccccttctctactaaaaatacaaaaattagctgggcgtggtggtgggtgcctgtaattgtagctacttgggaggctgaggcatgagaatcacttgaacccagaaagcagaggttgcagtgagctgagatggtgccactgcactccagcctgggtgacagagtgagactctgtcctaaaaaaaaaaaaaaaaaaaatggctgggcgtggtgcctcatgcctgtaatcccagcactttgggagtccagcgtgggtggatcacctgaggtcaggagttcaagtccagcctgaccaacatggtgaaaccccgtctctactaaaaaagtacaaaaaaaatagccgggtgtggtggcacactcctgtaatcccagctactcaggaggctgaggcaggagaatcacttgaatttgggagctggagattgtagtcagccaagatggtgccattgcactccagtctgggtgacagagtgagactccatctcaaaaaaaaaaaaaaaatcttaaaaactccttccagaagatttaatacttactttcacccaaccacccgacttgagtatcaccaataacagaggatacagtccgttttcagtagagccttagtagcaaagggttttcatttttatttttcagatacaggatcttgccctgtcacccaagctggagtgcagtgatgtgatcatagctgactgcagcctcctgagtagctaggactataggtgtattataggacaatttttaaaaaatttcattgtaaagacaggattccactgtgttgcccaggctgcaagtcttggcctcaagtgatcattccacctttaactcttgccctcaagcagtcctcccacctcagactcccaaaatgctgggattatgggtgtgagccaccatttccagcctactagcaagggtcttgttacatattacttggcatgatttatgtaatttaaaaaaattgtttgtttttcaaatagaaaagtaaaataacgaatatgcttttccaataacataatccccttctcacttgagaattttcctctaaaaagatatgctagatttatttcatgctttatgtgcctctggtgtgtccccttataacctcctccatatcatttagggatggtctcagctgcaagtaagaactgccacaacaggtgatgtaagcccaaaaaaaaaaaaaaaaaaaaagcaaagccaagcaaaacaaagcccatttaattatttcccataataataagtctgggagaaagaagattccagagttggctcagcagcttagtgacagcaaggccctaggctggcattttcttggccttcccgatggtcccaagatgactctcatggcctcaaacatcacttcctcacatcctgtcagggagaaagaggcaagtgagcaacaacaatttgtggtgtttggatcatttgtcagagaggaagaacgttcctaaaaactccgcctctgctgtttgacatcctcatcctattccttggccatggtggtatctcatggtcactcctctatctgccactgtaaagaggaactggattgctatattctgcttagacacatgaggatgcagcccaccttcccagaacatgtgcggaattagatttctacaaacacatttgtcttgcttctgcccaactctctcactagaatgcacattccataggggcaaacatttttgtctattttgttcacagctatattctcaacacctagaagagtgacagaaattcaataaatagttgttaagtgagcaaatgaatgcatgaataaggaaaagggtacatggctattgagtaggtaaccagcagtgttgatcacccccaacagcatacaactccagtctgatgaacatcatgctactaagtggccactcatcacccaagtctctgaccttactttttctctcttttctcccagggagtgagccataactggcggctgctcttgcgccaatg

SEQ ID NO: 2711 - DNA, 1654 bp; single-stranded, linear
ccaatgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggctacatcaactccacactgaaccccctcatctaccccttgtgcaatgagaacttcaagaagacattcaagagaattctgcatattcgctcctaagggaggctctgaggggatgcaacaaaatgatccttatgatgtccaacaaggaaatagaggacgaaggcctgtgtgttgccaggcaggcacctgggctttctggaatccaaaccacagtcttaggggcttggtagtttggaaagttcttaggcaccatagaagaacagcagatggcggtgatcagcag

SEQ ID NO: 2712 - DNA, 1742 bp; single-stranded, linear
atgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggctacatcaactccacactgaaccccctcatctaccccttgtgcaatgagaacttcaagaagacattcaagagaattctgcatattcgctcctaagggaggctctgaggggatgcaacaaaatgatccttatgatgtccaacaaggaaatagaggacgaaggcctgtgtgttgccaggcaggcacctgggctttctggaatccaaaccacagtcttaggggcttggtagtttggaaagttcttaggcaccatagaagaacagcagatggcggtgatcagcagagagattgaactttgaggaggaagcagaatctttgcaagaaagtcagacctgtttcttgtaactgggttcaaaaagaaaaaaaaaaaaaaa

SEQ ID NO: 2713 - DNA, 5836 bp; single-stranded, linear
atcctggctgatatggtgaaaccccatctctactaaaaatacaaaaattagctgggcgtggtggtgggcgcatgtaatcccagctactcaggaggctgaggcaggagaattacttgaacctgggaggcagaggttgcagtgaaccgagatcgcgccattgcactccagtctggcgacagagcgagactccgtctctaaataaataaataaataaatttagccttctactcaagaacttatctggctttgtcttaatgtaaaaataatttctttttgctaaattattgagagaaatttactatttattagtgtttatcagttttctttaaactcaccactttttgatgaatatgaaaatctaaaaacttggccgggcgcagtggctcacacctgtaatctcagcactttgggaggccaaggtgggcggatcatctgaggtcaggagttcaagatcagcctgaccaacatggtgaaaccccttctctactaaaaatacaaaaattagctgggcgtggtggtgggtgcctgtaattgtagctacttgggaggctgaggcatgagaatcacttgaacccagaaagcagaggttgcagtgagctgagatggtgccactgcactccagcctgggtgacagagtgagactctgtcctaaaaaaaaaaaaaaaaaaaatggctgggcgtggtgcctcatgcctgtaatcccagcactttgggagtccagcgtgggtggatcacctgaggtcaggagttcaagtccagcctgaccaacatggtgaaaccccgtctctactaaaaaagtacaaaaaaaatagccgggtgtggtggcacactcctgtaatcccagctactcaggaggctgaggcaggagaatcacttgaatttgggagctggagattgtagtcagccaagatggtgccattgcactccagtctgggtgacagagtgagactccatctcaaaaaaaaaaaaaaaatcttaaaaactccttccagaagatttaatacttactttcacccaaccacccgacttgagtatcaccaataacagaggatacagtccgttttcagtagagccttagtagcaaagggttttcatttttatttttcagatacaggatcttgccctgtcacccaagctggagtgcagtgatgtgatcatagctgactgcagcctcctgagtagctaggactataggtgtattataggacaatttttaaaaaatttcattgtaaagacaggattccactgtgttgcccaggctgcaagtcttggcctcaagtgatcattccacctttaactcttgccctcaagcagtcctcccacctcagactcccaaaatgctgggattatgggtgtgagccaccatttccagcctactagcaagggtcttgttacatattacttggcatgatttatgtaatttaaaaaaattgtttgtttttcaaatagaaaagtaaaataacgaatatgcttttccaataacataatccccttctcacttgagaattttcctctaaaaagatatgctagatttatttcatgctttatgtgcctctggtgtgtccccttataacctcctccatatcatttagggatggtctcagctgcaagtaagaactgccacaacaggtgatgtaagcccaaaaaaaaaaaaaaaaaaaaagcaaagccaagcaaaacaaagcccatttaattatttcccataataataagtctgggagaaagaagattccagagttggctcagcagcttagtgacagcaaggccctaggctggcattttcttggccttcccgatggtcccaagatgactctcatggcctcaaacatcacttcctcacatcctgtcagggagaaagaggcaagtgagcaacaacaatttgtggtgtttggatcatttgtcagagaggaagaacgttcctaaaaactccgcctctgctgtttgacatcctcatcctattccttggccatggtggtatctcatggtcactcctctatctgccactgtaaagaggaactggattgctatattctgcttagacacatgaggatgcagcccaccttcccagaacatgtgcggaattagatttctacaaacacatttgtcttgcttctgcccaactctctcactagaatgcacattccataggggcaaacatttttgtctattttgttcacagctatattctcaacacctagaagagtgacagaaattcaataaatagttgttaagtgagcaaatgaatgcatgaataaggaaaagggtacatggctattgagtaggtaaccagcagtgttgatcacccccaacagcatacaactccagtctgatgaacatcatgctactaagtggccactcatcacccaagtctctgaccttactttttctctcttttctcccagggagtgagccataactggcggctgctcttgcgccaatgccaatgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggctacatcaactccacactgaaccccctcatctaccccttgtgcaatgagaacttcaagaagacattcaagagaattctgcatattcgctcctaagggaggctctgaggggatgcaacaaaatgatccttatgatgtccaacaaggaaatagaggacgaaggcctgtgtgttgccaggcaggcacctgggctttctggaatccaaaccacagtcttaggggcttggtagtttggaaagttcttaggcaccatagaagaacagcagatggcggtgatcagcagatgagcctccccaattcctcctgcctcttagaagacaagatgtgtgagggcaacaagaccactatggccagcccccagctgatgcccctggtggtggtcctgagcactatctgcttggtcacagtagggctcaacctgctggtgctgtatgccgtacggagtgagcggaagctccacactgtggggaacctgtacatcgtcagcctctcggtggcggacttgatcgtgggtgccgtcgtcatgcctatgaacatcctctacctgctcatgtccaagtggtcactgggccgtcctctctgcctcttttggctttccatggactatgtggccagcacagcgtccattttcagtgtcttcatcctgtgcattgatcgctaccgctctgtccagcagcccctcaggtaccttaagtatcgtaccaagacccgagcctcggccaccattctgggggcctggtttctctcttttctgtgggttattcccattctaggctggaatcacttcatgcagcagacctcggtgcgccgagaggacaagtgtgagacagacttctatgatgtcacctggttcaaggtcatgactgccatcatcaacttctacctgcccaccttgctcatgctctggttctatgccaagatctacaaggccgtacgacaacactgccagcaccgggagctcatcaataggtccctcccttccttctcagaaattaagctgaggccagagaaccccaagggggatgccaagaaaccagggaaggagtctccctgggaggttctgaaaaggaagccaaaagatgctggtggtggatctgtcttgaagtcaccatcccaaacccccaaggagatgaaatccccagttgtcttcagccaagaggatgatagagaagtagacaaactctactgctttccacttgatattgtgcacatgcaggctgcggcagaggggagtagcagggactatgtagccgtcaaccggagccatggccagctcaagacagatgagcagggcctgaacacacatggggccagcgagatatcagaggatcagatgttaggtgatagccaatccttctctcgaacggactcagataccaccacagagacagcaccaggcaaaggcaaattgaggagtgggtctaacacaggcctggattacatcaagtttacttggaagaggctccgctcgcattcaagacagtatgtatctgggttgcacatgaaccgcgaaaggaaggccgccaaacagttgggttttatcatggcagccttcatcctctgctggatcccttatttcatcttcttcatggtcattgccttctgcaagaactgttgcaatgaacatttgcacatgttcaccatctggctgggctacatcaactccacactgaaccccctcatctaccccttgtgcaatgagaacttcaagaagacattcaagagaattctgcatattcgctcctaagggaggctctgaggggatgcaacaaaatgatccttatgatgtccaacaaggaaatagaggacgaaggcctgtgtgttgccaggcaggcacctgggctttctggaatccaaaccacagtcttaggggcttggtagtttggaaagttcttaggcaccatagaagaacagcagatggcggtgatcagcagagagattgaactttgaggaggaagcagaatctttgcaagaaagtcagacctgtttcttgtaactgggttcaaaaagaaaaaaaaaaaaaaa

SEQ ID NO: 2714 - DNA, 3579 bp; single-stranded, linear
cacgcgtccgcgagaaggaggactcgcaagcctcggcggcccggaaccggcctcggactgtcgacggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccggtcccttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagacaaagtgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattaaaaaaaaaaaaaaaa

SEQ ID NO: 2715 - DNA, 3058 bp; single-stranded, linear
gcccgcgttaagattcccgcattttaatgttttcaggggggtgtcatagccccgggtttggccgccccagccccgccttccccgccccggggagcccgcccccttccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctacaaaaaaaaaaaaaaa

SEQ ID NO: 2716 - DNA, 1994 bp; single-stranded, linear
ggcacgagcatggcccttgtgatccaggtggggaaactaaggcccagagaagtgaggaccccgcagactatcaatcccagtctcttcccctcactccctgtgaagctctccagcatcatcgaggtcccatcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgcccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgccgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaaaaaaaaaaaaaaa

SEQ ID NO: 2717 - DNA, 8631 bp; single-stranded, linear
cacgcgtccgcgagaaggaggactcgcaagcctcggcggcccggaaccggcctcggactgtcgacggaacctgaggccgcttgccctcccgccccatggagcggcccccggggctgcggccgggcgcgggcgggccctgggagatgcgggagcggctgggcaccggcggcttcgggaacgtctgtctgtaccagcatcgggaacttgatctcaaaatagcaattaagtcttgtcgcctagagctaagtaccaaaaacagagaacgatggtgccatgaaatccagattatgaagaagttgaaccatgccaatgttgtaaaggcctgtgatgttcctgaagaattgaatattttgattcatgatgtgcctcttctagcaatggaatactgttctggaggagatctccgaaagctgctcaacaaaccagaaaattgttgtggacttaaagaaagccagatactttctttactaagtgatatagggtctgggattcgatatttgcatgaaaacaaaattatacatcgagatctaaaacctgaaaacatagttcttcaggatgttggtggaaagataatacataaaataattgatctgggatatgccaaagatgttgatcaaggaagtctgtgtacatcttttgtgggaacactgcagtatctggccccagagctctttgagaataagccttacacagccactgttgattattggagctttgggaccatggtatttgaatgtattgctggatataggccttttttgcatcatctgcagccatttacctggcatgagaagattaagaagaaggatccaaagtgtatatttgcatgtgaagagatgtcaggagaagttcggtttagtagccatttacctcaaccaaatagcctttgtagtttaatagtagaacccatggaaaactggctacagttgatgttgaattgggaccctcagcagagaggaggacctgttgaccttactttgaagcagccaagatgttttgtattaatggatcacattttgaatttgaagatagtacacatcctaaatatgacttctgcaaagataatttcttttctgttaccacctgatgaaagtcttcattcactacagtctcgtattgagcgtgaaactggaataaatactggttctcaagaacttctttcagagacaggaatttctctggatcctcggaaaccagcctctcaatgtgttctagatggagttagaggctgtgatagctatatggtttatttgtttgataaaagtaaaactgtatatgaagggccatttgcttccagaagtttatctgattgtgtaaattatattgtacaggacagcaaaatacagcttccaattatacagctgcgtaaagtgtgggctgaagcagtgcactatgtgtctggactaaaagaagactatagcaggctctttcagggacaaagggcagcaatgttaagtcttcttagatataatgctaacttaacaaaaatgaagaacactttgatctcagcatcacaacaactgaaagctaaattggagttttttcacaaaagcattcagcttgacttggagagatacagcgagcagatgacgtatgggatatcttcagaaaaaatgctaaaagcatggaaagaaatggaagaaaaggccatccactatgctgaggttggtgtcattggatacctggaggatcagattatgtctttgcatgctgaaatcatggagctacagaagagcccctatggaagacgtcagggagacttgatggaatctctggaacagcgtgccattgatctatataagcagttaaaacacagaccttcagatcactcctacagtgacagcacagagatggtgaaaatcattgtgcacactgtgcagagtcaggaccgtgtgctcaaggagctgtttggtcatttgagcaagttgttgggctgtaagcagaagattattgatctactccctaaggtggaagtggccctcagtaatatcaaagaagctgacaatactgtcatgttcatgcagggaaaaaggcagaaagaaatatggcatctccttaaaattgcctgtacacagagttctgcccggtcccttgtaggatccagtctagaaggtgcagtaacccctcagacatcagcatggctgcccccgacttcagcagaacatgatcattctctgtcatgtgtggtaactcctcaagatggggagacttcagcacaaatgatagaagaaaatttgaactgccttggccatttaagcactattattcatgaggcaaatgaggaacagggcaatagtatgatgaatcttgattggagttggttaacagaatgagttgtcacttgttcactgtccccaaacctatggaagttgttgctatacatgttggaaatgtgtttttcccccatgaaaccattcttcagacatcagtcaatggaagaaatggctatgaacagaaactacatttctactatgatcagaagaacatgattttacaagtataacagttttgagtaattcaagcctctaaacagacaggaatttagaaaaagtcaatgtacttgtttgaatatttgttttaataccacagctatttagaagcatcatcacgacacatttgccttcagtcttggtaaaacattacttatttaactgattaaaaataccttctatgtattagtgtcaacttttaacttttgggcgtaagacaaagtgtagttttgtatacagagaagaaaacctcaagtaataggcattttaagtaaaagtctacctgtgtttttttctaaaaaggctgctcacaagttctatttcttgaagaataaattctacctccttgtgttgcactgaacaggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattaaaaaaaaaaaaaaaagcccgcgttaagattcccgcattttaatgttttcaggggggtgtcatagccccgggtttggccgccccagccccgccttccccgccccggggagcccgcccccttccccgcgtccctgccgacagagttagcacgacatcagtatgagctggtcaccttccctgacaacgcagacatgtggggcctgggaaatgaaagagcgccttgggacagggggatttggaaatgtcatccgatggcacaatcaggaaacaggtgagcagattgccatcaagcagtgccggcaggagctcagcccccggaaccgagagcggtggtgcctggagatccagatcatgagaaggctgacccaccccaatgtggtggctgcccgagatgtccctgaggggatgcagaacttggcgcccaatgacctgcccctgctggccatggagtactgccaaggaggagatctccggaagtacctgaaccagtttgagaactgctgtggtctgcgggaaggtgccatcctcaccttgctgagtgacattgcctctgcgcttagataccttcatgaaaacagaatcatccatcgggatctaaagccagaaaacatcgtcctgcagcaaggagaacagaggttaatacacaaaattattgacctaggatatgccaaggagctggatcagggcagtctttgcacatcattcgtggggaccctgcagtacctggccccagagctactggagcagcagaagtacacagtgaccgtcgactactggagcttcggcaccctggcctttgagtgcatcacgggcttccggcccttcctccccaactggcagcccgtgcagtggcattcaaaagtgcggcagaagagtgaggtggacattgttgttagcgaagacttgaatggaacggtgaagttttcaagctctttaccctaccccaataatcttaacagtgtcctggctgagcgactggagaagtggctgcaactgatgctgatgtggcacccccgacagaggggcacggatcccacgtatgggcccaatggctgcttcaaggccctggatgacatcttaaacttaaagctggttcatatcttgaacatggtcacgggcaccatccacacctaccctgtgacagaggatgagagtctgcagagcttgaaggccagaatccaacaggacacgggcatcccagaggaggaccaggagctgctgcaggaagcgggcctggcgttgatccccgataagcctgccactcagtgtatttcagacggcaagttaaatgagggccacacattggacatggatcttgtttttctctttgacaacagtaaaatcacctatgagactcagatctccccacggccccaacctgaaagtgtcagctgtatccttcaagagcccaagaggaatctcgccttcttccagctgaggaaggtgtggggccaggtctggcacagcatccagaccctgaaggaagattgcaaccggctgcagcagggacagcgagccgccatgatgaatctcctccgaaacaacagctgcctctccaaaatgaagaattccatggcttccatgtctcagcagctcaaggccaagttggatttcttcaaaaccagcatccagattgacctggagaagtacagcgagcaaaccgagtttgggatcacatcagataaactgctgctggcctggagggaaatggagcaggctgtggagctctgtgggcgggagaacgaagtgaaactcctggtagaacggatgatggctctgcagaccgacattgtggacttacagaggagccccatgggccggaagcaggggggaacgctggacgacctagaggagcaagcaagggagctgtacaggagactaagggaaaaacctcgagaccagcgaactgagggtgacagtcaggaaatggtacggctgctgcttcaggcaattcagagcttcgagaagaaagtgcgagtgatctatacgcagctcagtaaaactgtggtttgcaagcagaaggcgctggaactgttgcccaaggtggaagaggtggtgagcttaatgaatgaggatgagaagactgttgtccggctgcaggagaagcggcagaaggagctctggaatctcctgaagattgcttgtagcaaggtccgtggtcctgtcagtggaagcccggatagcatgaatgcctctcgacttagccagcctgggcagctgatgtctcagccctccacggcctccaacagcttacctgagccagccaagaagagtgaagaactggtggctgaagcacataacctctgcaccctgctagaaaatgccatacaggacactgtgagggaacaagaccagagtttcacggccctagactggagctggttacagacggaagaagaagagcacagctgcctggagcaggcctcatgatgtggggggactcgaccccctgacatggggcagcccatagcaggccttgtgcagtggggggactcgaccccctgacatggggctgcctggagcaggccgcgtgacgtggggctgcctggccgcggctctcacatggtggttcctgctgcactgatggcccaggggtctctggtatccagatggagctctcgcttcctcagcagctgtgactttcacccaggacccaggacgcagccctccgtgggcactgccggcgccttgtctgcacactggaggtcctccattacagaggcccagcgcacatcgctggccccacaaacgttcaggggtacagccatggcagctccttcctctgccgtgagaaaagtgcttggagtacggtttgccacacacgtgactggacagtgtccaattcaaatctttcagggcagagtccgagcagcgcttggtgacagcctgtcctctcctgctctccaaaggccctgctccctgtcctctctcactttacagcttgtgtttcttctggattcagcttctcctaaacagacagtttaattatagttgcggcctggccccatcctcacttcctctttttatttcactgctgctaaaattgtgtttttacctacaaaaaaaaaaaaaaaggcacgagcatggcccttgtgatccaggtggggaaactaaggcccagagaagtgaggaccccgcagactatcaatcccagtctcttcccctcactccctgtgaagctctccagcatcatcgaggtcccatcagcccttgccctgttggatgaataggcacctctggaagagccaactgtgtgagatggtgcagcccagtggtggcccggcagcagatcaggacgtactgggcgaagagtctcctctggggaagccagccatgctgcacctgccttcagaacagggcgctcctgagaccctccagcgctgcctggaggagaatcaagagctccgagatgccatccggcagagcaaccagattctgcgggagcgctgcgaggagcttctgcatttccaagccagccagagggaggagaaggagttcctcatgtgcaagttccaggaggccaggaaactggtggagagactcggcctggagaagctcgatctgaagaggcagaaggagcaggctctgcgggaggtggagcacctgaagagatgccagcagcagatggctgaggacaaggcctctgtgaaagcccaggtgacgtccttgctcggggagctgcaggagagccagagtcgcttggaggctgccactaaggaatgccaggctctggagggtcgggcccgggcggccagcgagcaggcgcggcagctggagagtgagcgcgaggcgctgcagcagcagcacagcgtgcaggtggaccagctgcgcatgcagggccagagcgtggaggccgcgctccgcatggagcgccaggccgcctcggaggagaagaggaagctggcccagttgcaggtggcctatcaccagctcttccaagaatacgacaaccacatcaagagcagcgtggtgggcagtgagcggaagcgaggaatgcagctggaagatctcaaacagcagctccagcaggccgaggaggccctggtggccaaacaggaggtgatcgataagctgaaggaggaggccgagcagcacaagattgtgatggagaccgttccggtgctgaaggcccaggcggatatctacaaggcggacttccaggctgagaggcaggcccgggagaagctggccgagaagaaggagctcctgcaggagcagctggagcagctgcagagggagtacagcaaactgaaggccagctgtcaggagtcggccaggatcgaggacatgaggaagcggcatgtcgaggtctcccaggcccccttgccccccgcccctgcctacctctcctctcccctggccctgcccagccagaggaggagcccccccgaggagccacctgacttctgctgtcccaagtgccagtatcaggcccctgatatggacaccctgcagatacatgtcatggagtgcattgagtagggccggccagtgcaaggccactgcctgcccgaggacgtgcccgggaccgtgcagtctgcgctttcctctcccgcctgcctagcccaggatgaagggctgggtggccacaactgggatgccacctggagccccacccaggagctggccgcggcaccttacgcttcagctgttgatccgctggtcccctcttttggggtagatgcggccccgatcaggcctgactcgctgctctttttgttcccttctgtctgctcgaaccacttgcctcgggctaatccctccctcttcctccacccggcactggggaagtcaagaatggggcctggggctctcagggagaactgcttcccctggcagagctgggtggcagctcttcctcccaccggacaccgacccgcccgccgctgtgccctgggagtgctgccctcttaccatgcacacgggtgctctccttttgggctgcatgctattccattttgcagccagaccgatgtgtatttaaccagtcactattgatggacatttgggttgtttcccatctttttgttaccataaataatggcatagtaaaaaaaaaaaaaaaaaa

SEQ ID NO: 2718 - DNA, 1589 bp; single-stranded, linear
gaattcctctggtcctcatccaggtgcgcgggaagcaggtgcccaggagagaggggataatgaagattccatgctgatgatcccaaagattgaacctgcagaccaagcgcaaagtagaaactgaaagtacactgctggcggatcctacggaagttatggaaaaggcaaagcgcagagccacgccgtagtgtgtgccgccccccttgggatggatgaaactgcagtcgcggcgtgggtaagaggaaccagctgcagagatcaccctgcccaacacagactcggcaactccgcggaagaccagggtcctgggagtgactatgggcggtgagagcttgctcctgctccagttgcggtcatcatgactacgcccgcctcccgcagaccatgttccatgtttcttttaggtatatctttggacttcctcccctgatccttgttctgttgccagtagcatcatctgattgtgatattgaaggtaaagatggcaaacaatatgagagtgttctaatggtcagcatcgatcaattattggacagcatgaaagaaattggtagcaattgcctgaataatgaatttaacttttttaaaagacatatctgtgatgctaataaggaaggtatgtttttattccgtgctgctcgcaagttgaggcaatttcttaaaatgaatagcactggtgattttgatctccacttattaaaagtttcagaaggcacaacaatactgttgaactgcactggccaggttaaaggaagaaaaccagctgccctgggtgaagcccaaccaacaaagagtttggaagaaaataaatctttaaaggaacagaaaaaactgaatgacttgtgtttcctaaagagactattacaagagataaaaacttgttggaataaaattttgatgggcactaaagaacactgaaaaatatggagtggcaatatagaaacacgaactttagctgcatcctccaagaatctatctgcttatgcagtttttcagagtggaatgcttcctagaagttactgaatgcaccatggtcaaaacggattagggcatttgagaaatgcatattgtattactagaagatgaatacaaacaatggaaactgaatgctccagtcaacaaactatttcttatatatgtgaacatttatcaatcagtataattctgtactgatttttgtaagacaatccatgtaaggtatcagttgcaataatacttctcaaacctgtttaaatatttcaagacattaaatctatgaagtatataatggtttcaaagattcaaaattgacattgctttactgtcaaaataattttatggctcactatgaatctattatactgtattaagagtgaaaattgtcttcttctgtgctggagatgttttagagttaacaatgatatatggataatgccggtgagaataagagagtcataaaccttaagtaagcaacagcataacaaggtccaagatacctaaaagagatttcaagagatttaattaatcatgaatgtgtaacacagtgccttcaataaatggtatagcaaatgttttgacatgaaaaaaggacaatttcaaaaaaataaaat

SEQ ID NO: 2719 - DNA, 141589 bp; single-stranded, linear; identical to SEQ ID NO: 2480

SEQ ID NO: 2720 - DNA, 533 bp; single-stranded, linear
atttttttgtagagacagggtctctctatgttgcccaggctggtttcaaactcccaggctcaagcaatcctcctgccttggcctcccaaagtgctggcattacaggcgtgagccactgcgcctggcccgtattaatgtttagaacacgaattccaggaggcaggctaagtctattcagcttgttcatatgcttgggccaacccaagaaacaagtgggtgacaaatggcaccttttggatagtggtattgactttgaaagtttgggtcaggaagctggggaggaagggtgggcaggctgtgggcagtcctgggcggaagaccaggcagggctatgtgctcactgagcctccgccctcttcctttgaatctctgatagacttctgcctcctacttctccttttctgcccttctttgctttggtggcttccttgtggttcctcagtggtgcctgcaacccctggttcacctccttccaggttctggctccttccagccatggctctcagagtccttctgttaacaggtgcatgggg

SEQ ID NO: 2721 - DNA, 4740 bp; single-stranded, linear
gaattccgtggttcctcagtggtgcctgcaacccctggttcacctccttccaggttctggctccttccagccatggctctcagagtccttctgttaacagccttgaccttatgtcatgggttcaacttggacactgaaaacgcaatgaccttccaagagaacgcaaggggcttcgggcagagcgtggtccagcttcagggatccagggtggtggttggagccccccaggagatagtggctgccaaccaaaggggcagcctctaccagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacactccagaaccagcgctcacagcgatcctggcgcctggcctgtgagtctgcctcctccaccgaagtgtctggggccttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagcctccccatcagcctggtgttcttggtgcccgtccggctgaaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccagagaatccagtgtgacatcccgttctttggcatccaggaagaattcaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcgagtgtgtgcaagtgtctgtgtgcaagtgtgtgcacgtgtgcgtgtgcgtgcatgtgcactcgcacgcccatgtgtgagtgtgtgcaagtatgtgagtgtgtccagtgtgtgtgcgtgtgtccatgtgtgtgcagtgtgtgcatgtgtgcgagtgtgtgcatgtgtgtgctcaggggctgtggctcacgtgtgtgactcagagtgtctctggcgtgtgggtaggtgacggcagcgtagcctctccggcagaagggaactgcctgggctcccttgtgcgtgggtaagccgctgctgggttttcctccgggagaggggacggtcaatcctgtgggtgaagagagagggaaacacagcagcatctctccactgaaagaagtgggacttcccgtcgcctgcgagcctgcggcctgctggagcctgcgcagcttggatggatactccatgagaaaagccgtgggtggaaccaggagcctcctccacaccagcgctgatgcccaataaagatgcccactgaggaatcatgaagcttcctttctggattcatttattatttcaatgtgactttaattttttggatggataagcctgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacaccacacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcatctcttgttattgcatctgctgagttaataaatcaaatatatgtcaaaaaaaaaaaaaaaaaaaaaaaaaaaaaaaaaaaaaaaaa

SEQ ID NO: 2722 - DNA, 1774 bp; single-stranded, linear
ggttcaagtgattctgctgcctcagcctcccaggcgggattacaggtgcctgccaccacgcctggctaatttttttgtctttttagtaaagatgaggtttcaccatgttgggcaggctggtttcaattgctgacctcaagtgagccaccccgcctcagcctccaaaatgctaggattacaggcatgagccaccgcacccagccaagtttgtacatatatttttgactacacttcttaactattcttaggataaattactagaagtgaaaattcttgggtgaagagcttgaggcctttacacacacacacacacacacacacacacacacacaaataggctggatcgagtggctcacacctgtaatctcagcagtttgggaggctgaggaaggaggatcacttgagtccaggaggttgagaatagcctgaacaacatagcaagatcttgtctctacaaaaaagtttaaaaaaaattagctggccatggcagcatgtgcctgtagtaccagctactcggaaggctgaggtaggaggatcgcttgagcccaggaggtgattgaagctgcagtgagctgtgattacaccactgcactccagcctgggcaacagagctagactctgtctctaaaaaaaggcacaaaataatatttaaaaagcaccaggtatgcctgtacttgagttgtctttgttgatggctacaaatgagacagctctggctgaagggcggcttccatttccatgggctggaggaggacattttgcaaagtgtgttttcaggaagacacagagttttacctcctacacttgtttgatctgtattaatgtttgcttatttatttatttaattttttttttgagacagagtctcactctgtcacctgggctggagtgcagtggcattattgaggctcattgcagtctcagactcctgagctcaaacaatcctcctgcctcagcctctggagtagctaggactacaggcatgtgccaccatgcctggctaattttttaaatgtatttttttgtagagtcggggtctccctatgttgcccaggctggagtgcagtggtgtgatcctagctcactgcagcctggacctcgggctcaagaaattctcacacctcagcctgtccagtagcaggggctacaggcgcgcaccaccatcccagctaattaaaaatatttttttgtagagacagggtctctctatgttgcccaggctggtttcaaactcccaggctcaagcaatcctcctgccttgcctcccaaatgacatcggattacaggcgtgagccactgagcctggcccgtattaatgtttagaacacgaattccaggaggcaggctaagtctattcagcttgttcatatgcttgggccaacccaagaaacaagtgggtgacaaatggcaccttttggatagtggtattgactttgaaagtttgggtcaggagctggggaggaagggtgggcaggctgtgggcagtcctgggcggaagaccaggcagggctatgtgctcactgagcctccgccctcttcctttgaatctctgatagacttctgcctcctacttctccttttctgcccttctttgctttggtggcttccttgtggttcctcagtggtgcctgcaaccctggttcactcttccaggttctggctccttccagccatggctctcagagtccttctgttaacaggtgcatgggggtggggtgggggactctgggtggggaggagggtaacttttgggtctgtcataaatagagggccc

SEQ ID NO: 2723 - DNA, 7047 bp; single-stranded, linear
atttttttgtagagacagggtctctctatgttgcccaggctggtttcaaactcccaggctcaagcaatcctcctgccttggcctcccaaagtgctggcattacaggcgtgagccactgcgcctggcccgtattaatgtttagaacacgaattccaggaggcaggctaagtctattcagcttgttcatatgcttgggccaacccaagaaacaagtgggtgacaaatggcaccttttggatagtggtattgactttgaaagtttgggtcaggaagctggggaggaagggtgggcaggctgtgggcagtcctgggcggaagaccaggcagggctatgtgctcactgagcctccgccctcttcctttgaatctctgatagacttctgcctcctacttctccttttctgcccttctttgctttggtggcttccttgtggttcctcagtggtgcctgcaacccctggttcacctccttccaggttctggctccttccagccatggctctcagagtccttctgttaacaggtgcatgggggaattccgtggttcctcagtggtgcctgcaacccctggttcacctccttccaggttctggctccttccagccatggctctcagagtccttctgttaacagccttgaccttatgtcatgggttcaacttggacactgaaaacgcaatgaccttccaagagaacgcaaggggcttcgggcagagcgtggtccagcttcagggatccagggtggtggttggagccccccaggagatagtggctgccaaccaaaggggcagcctctaccagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacactccagaaccagcgctcacagcgatcctggcgcctggcctgtgagtctgcctcctccaccgaagtgtctggggccttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagcctccccatcagcctggtgttcttggtgcccgtccggctgaaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccagagaatccagtgtgacatcccgttctttggcatccaggaagaattcaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcgagtgtgtgcaagtgtctgtgtgcaagtgtgtgcacgtgtgcgtgtgcgtgcatgtgcactcgcacgcccatgtgtgagtgtgtgcaagtatgtgagtgtgtccagtgtgtgtgcgtgtgtccatgtgtgtgcagtgtgtgcatgtgtgcgagtgtgtgcatgtgtgtgctcaggggctgtggctcacgtgtgtgactcagagtgtctctggcgtgtgggtaggtgacggcagcgtagcctctccggcagaagggaactgcctgggctcccttgtgcgtgggtaagccgctgctgggttttcctccgggagaggggacggtcaatcctgtgggtgaagagagagggaaacacagcagcatctctccactgaaagaagtgggacttcccgtcgcctgcgagcctgcggcctgctggagcctgcgcagcttggatggatactccatgagaaaagccgtgggtggaaccaggagcctcctccacaccagcgctgatgcccaataaagatgcccactgaggaatcatgaagcttcctttctggattcatttattatttcaatgtgactttaattttttggatggataagcctgtctatggtacaaaaatcacaaggcattcaagtgtacagtgaaaagtctccctttccagatattcaagtcacctccttaaaggtagtcaagattgtgttttgaggtttccttcagacagattccaggcgatgtgcaagtgtatgcacgtgtgcacacaccacacacatacacacacacaagcttttttacacaaatggtagcatactttatattggtctgtatcttgctttttttcaccaatatttctcagacatcggttcatattaagacataaattactttttcattcttttataccgctgcatagtattccattgtgtgagtgtaccataatgtatttaaccagtcttcttttgatatactattttcatctcttgttattgcatctgctgagttaataaatcaaatatatgtcaaaaaaaaaaaaaaaaaaaaaaaaaaaaaaaaaaaaaaaaaggttcaagtgattctgctgcctcagcctcccaggcgggattacaggtgcctgccaccacgcctggctaatttttttgtctttttagtaaagatgaggtttcaccatgttgggcaggctggtttcaattgctgacctcaagtgagccaccccgcctcagcctccaaaatgctaggattacaggcatgagccaccgcacccagccaagtttgtacatatatttttgactacacttcttaactattcttaggataaattactagaagtgaaaattcttgggtgaagagcttgaggcctttacacacacacacacacacacacacacacacacacaaataggctggatcgagtggctcacacctgtaatctcagcagtttgggaggctgaggaaggaggatcacttgagtccaggaggttgagaatagcctgaacaacatagcaagatcttgtctctacaaaaaagtttaaaaaaaattagctggccatggcagcatgtgcctgtagtaccagctactcggaaggctgaggtaggaggatcgcttgagcccaggaggtgattgaagctgcagtgagctgtgattacaccactgcactccagcctgggcaacagagctagactctgtctctaaaaaaaggcacaaaataatatttaaaaagcaccaggtatgcctgtacttgagttgtctttgttgatggctacaaatgagacagctctggctgaagggcggcttccatttccatgggctggaggaggacattttgcaaagtgtgttttcaggaagacacagagttttacctcctacacttgtttgatctgtattaatgtttgcttatttatttatttaattttttttttgagacagagtctcactctgtcacctgggctggagtgcagtggcattattgaggctcattgcagtctcagactcctgagctcaaacaatcctcctgcctcagcctctggagtagctaggactacaggcatgtgccaccatgcctggctaattttttaaatgtatttttttgtagagtcggggtctccctatgttgcccaggctggagtgcagtggtgtgatcctagctcactgcagcctggacctcgggctcaagaaattctcacacctcagcctgtccagtagcaggggctacaggcgcgcaccaccatcccagctaattaaaaatatttttttgtagagacagggtctctctatgttgcccaggctggtttcaaactcccaggctcaagcaatcctcctgccttgcctcccaaatgacatcggattacaggcgtgagccactgagcctggcccgtattaatgtttagaacacgaattccaggaggcaggctaagtctattcagcttgttcatatgcttgggccaacccaagaaacaagtgggtgacaaatggcaccttttggatagtggtattgactttgaaagtttgggtcaggagctggggaggaagggtgggcaggctgtgggcagtcctgggcggaagaccaggcagggctatgtgctcactgagcctccgccctcttcctttgaatctctgatagacttctgcctcctacttctccttttctgcccttctttgctttggtggcttccttgtggttcctcagtggtgcctgcaaccctggttcactcttccaggttctggctccttccagccatggctctcagagtccttctgttaacaggtgcatgggggtggggtgggggactctgggtggggaggagggtaacttttgggtctgtcataaatagagggccc

SEQ ID NO: 2724 - DNA, 779 bp; single-stranded, linear
ctgcagctccggaacgggggggggctgctctccaccgcccctgtgcggccgcccgggaaagtgcaggcgggccgggcgcggtggctcacgcctgtgatctcagcactttgggaggccgaggtgggcggatcacctgaggtcgggagttcgaggccagcctgcccaacatggagaaaccctgtctctactaaagatacaaaattagccaggcgtggtgacgcatgcctgtaatcccagctactggagtggctgaggcaggagaatcgcttgagcccgggagacagaggttgcggtgagctgagatcgcaccattgcactccagcctgggcaacaagagcgaaactcagaaaaaaaagaaaagaaagtgcaggggacccgccgtcggggtgggggcggcgctgcccagcctctgtcccacttccatgcacttgacctcgaccctccggcctccgtctgcgatcttcccgtgcctgaatatgaggcttggaacagacccagaccttcctgcctgcccgtcctgagtggccccgggaccccgccccatctttggcccccagcccctgcctctctgccgcctccagggtcgggggtcaggccaggaaagccccttgggaagcccccggggagcagctggagcggggtcgccgggcggcgggaaggagtgggcgcctctatttaagcggcttccccgcggcctcgggacagaggggactgagcatggatttcggactggccctcctgctggcggggcttctggggctcctcctcggtgagaaggg

SEQ ID NO: 2725 - DNA, 1598 bp; single-stranded, linear
atggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtcctgcacagcccgacctccccggagcctcccgacaccacctccccggagcctcccaacaccacctccccggagtctcccgacaccacctccccggagtctcccgacaccacctcccaggagcctcccgacaccacctcccaggagcctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacgtatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgctcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgat

SEQ ID NO: 2726 - DNA, 350 bp; single-stranded, linear
tccatcacagccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccggtgagtccgc

SEQ ID NO: 2727 - DNA, 305 bp; single-stranded, linear
gtcgccgcaggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacggtgaggcgtc

SEQ ID NO: 2728 - DNA, 353 bp; single-stranded, linear
ctgtttccagtcctgcacagcccgacctccccggagcctcccgacaccacctccccggagcctcccaacaccacctccccggagtctcccgacaccacctccccggagtctcccgacaccacctcccaggagcctcccgacaccacctcccaggagcctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctgtgagttctg

SEQ ID NO: 2729 - DNA, 608 bp; single-stranded, linear
ctctccccagcgtccaaacctgcgggtgaccagctgcccgcggctctgtggaccagcagtgcggtgctgggactgctgctcctggccttgcccacgtatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgat

SEQ ID NO: 2730 - DNA, 1546 bp; single-stranded, linear
gggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtcctgcacagcccgacctccccggagcctcccgacaccacctccccggagtctcccgacaccacctccccggagtctcccgacaccacctccccggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacgtatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgataaaaaaaaaa

SEQ ID NO: 2731 - DNA, 5539 bp; single-stranded, linear
ctgcagctccggaacgggggggggctgctctccaccgcccctgtgcggccgcccgggaaagtgcaggcgggccgggcgcggtggctcacgcctgtgatctcagcactttgggaggccgaggtgggcggatcacctgaggtcgggagttcgaggccagcctgcccaacatggagaaaccctgtctctactaaagatacaaaattagccaggcgtggtgacgcatgcctgtaatcccagctactggagtggctgaggcaggagaatcgcttgagcccgggagacagaggttgcggtgagctgagatcgcaccattgcactccagcctgggcaacaagagcgaaactcagaaaaaaaagaaaagaaagtgcaggggacccgccgtcggggtgggggcggcgctgcccagcctctgtcccacttccatgcacttgacctcgaccctccggcctccgtctgcgatcttcccgtgcctgaatatgaggcttggaacagacccagaccttcctgcctgcccgtcctgagtggccccgggaccccgccccatctttggcccccagcccctgcctctctgccgcctccagggtcgggggtcaggccaggaaagccccttgggaagcccccggggagcagctggagcggggtcgccgggcggcgggaaggagtgggcgcctctatttaagcggcttccccgcggcctcgggacagaggggactgagcatggatttcggactggccctcctgctggcggggcttctggggctcctcctcggtgagaagggatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtcctgcacagcccgacctccccggagcctcccgacaccacctccccggagcctcccaacaccacctccccggagtctcccgacaccacctccccggagtctcccgacaccacctcccaggagcctcccgacaccacctcccaggagcctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacgtatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgctcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgattccatcacagccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccggtgagtccgcgtcgccgcaggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacggtgaggcgtcctgtttccagtcctgcacagcccgacctccccggagcctcccgacaccacctccccggagcctcccaacaccacctccccggagtctcccgacaccacctccccggagtctcccgacaccacctcccaggagcctcccgacaccacctcccaggagcctcccgacaccacctcccaggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctgtgagttctgctctccccagcgtccaaacctgcgggtgaccagctgcccgcggctctgtggaccagcagtgcggtgctgggactgctgctcctggccttgcccacgtatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgatgggactgagcatggatttcggactggccctcctgctggcggggcttctggggctcctcctcggccagtccctccaggtgaagcccctgcaggtggagcccccggagccggtggtggccgtggccttgggcgcctcgcgccagctcacctgccgcctggcctgcgcggaccgcggggcctcggtgcagtggcggggcctggacaccagcctgggcgcggtgcagtcggacacgggccgcagcgtcctcaccgtgcgcaacgcctcgctgtcggcggccgggacccgcgtgtgcgtgggctcctgcgggggccgcaccttccagcacaccgtgcagctccttgtgtacgccttcccggaccagctgaccgtctccccagcagccctggtgcctggtgacccggaggtggcctgtacggcccacaaagtcacgcccgtggaccccaacgcgctctccttctccctgctcgtcgggggccaggaactggagggggcgcaagccctgggcccggaggtgcaggaggaggaggaggagccccagggggacgaggacgtgctgttcagggtgacagagcgctggcggctgccgcccctggggacccctgtcccgcccgccctctactgccaggccacgatgaggctgcctggcttggagctcagccaccgccaggccatccccgtcctgcacagcccgacctccccggagcctcccgacaccacctccccggagtctcccgacaccacctccccggagtctcccgacaccacctccccggagcctcccgacaccacctccccggagcctcccgacaagacctccccggagcccgccccccagcagggctccacacacacccccaggagcccaggctccaccaggactcgccgccctgagatctcccaggctgggcccacgcagggagaagtgatcccaacaggctcgtccaaacctgcgggtgaccagctgcccgcggctctgtggaccagcagtgcggtgctgggactgctgctcctggccttgcccacgtatcacctctggaaacgctgccggcacctggctgaggacgacacccacccaccagcttctctgaggcttctgccccaggtgtcggcctgggctgggttaagggggaccggccaggtcgggatcagcccctcctgagtggccagcctttccccctgtgaaagcaaaatagcttggaccccttcaagttgagaactggtcagggcaaacctgcctcccattctactcaaagtcatccctctgttcacagagatggatgcatgttctgattgcctctttggagaagctcatcagaaactcaaaagaaggccactgtttgtctcacctacccatgacctgaagcccctccctgagtggtccccacctttctggacggaaccacgtactttttacatacattgattcatgtctcacgtctccctaaaaatgcgtaagaccaagctgtgccctgaccaccctgggcccctgtcgtcaggacctcctgaggctttggcaaataaacctcctaaaatgataaaaaaaaaa

SEQ ID NO: 2732 - DNA, 1539 bp; single-stranded, linear; identical to SEQ ID NO: 2678

SEQ ID NO: 2733 - DNA, 3160 bp; single-stranded, linear
aattaaccctcactaaagggagtcgactcgatccccccgcctcagccccttttttcttttttttttcattttcagttcaggagagttttagcttaattataggctacagaaccagctttgggcttcatctatcctttctaatatttactgtttcctatttctctaatcctagctctttatttcttccctttactttcactgggcttattttgctatagtggaatgcagagggatgagtattccaggaaggcacaaaaactgtgccaagtcttggagctagggatgagtgggaaagggacatgttcaaccattttaggccattccctccccacctcccagctcccagatatgtgcccctcgcaggaggagcccaggaatgggccaaacacctcacttctttgctctgagggccaccccagccctcccatcaacagctctagaaacccaatggtccttcctggaaacacggggcctgcatcaatcagaggtgtttgaaccatgtccctctgggcctgaggggcagaaggggacacaatatgtaatgtaaggagcccctgtcatcagaaatctgacttaatctgttttcagatattagacttccacataaaagttgacttggaaaaagacttctgctgctaaacaaaagttgaaactgccttggtgataaaatataagcagaccagctttctcttctagctttccctctcatttcccataagattttggtcaagttatttaatctctctgcatccgtttcctcttctatgaaatgggcatgataataatggtatatacctcctcaaggggggtataacgtgaacagagtccttagcacagcactctgtctctacgggagtgaattttcattgtttttctctttcctgttggagaaagtaagaagaaaacagcgcctttatggcttcccatggtgaatggctggggcgcgtctgtgtccctgtctcctctctggctccttgtggcctgaacagccagaaggaagccatgccatgctgtttcagccctcagcttccctcttgcatttcctagaaaagtctttggtgcccagctccagctcagcagattcaggatcccccttcatcatgacttggtcaacgccctgctcaggccaaggtcctctgagagttccaagcttctccactccctataaaaggccggcggaacagccagaggagcagagaggcaaagaaacattgtgaaatctccaactcttaaccttcaacatgaaagtctctgcagtgcttctgtgcctgctgctcatgacagcagctttcaacccccagggacttgctcagccaggtaagtcacctcccttcgactctccctctctttccctctgtttctctattcaaggaagacctaagcccgagtgctcctccactttttttttagattgagtctcattatgttgcccaggctgaagtgcaggggtgcgatcttggctcattgcaaccttcacctcccaggttcaagcgattctcttgcctcagccttctgagtagctgtgattacaggcaccgccatcacgtgcagctaatttttgtatttttagtagagaaggggtttcactatgttggccaggctggtctcaaactcttgacctcaagtgatcctcccgtctcggcctcccaaagtgctgggattacaggcgtgagcaccaggcccagccaagtgccccacttctaagcccaccagaatagtaaggctcctcagaggttcactttaacatctaattttaaagatagaaagctgaagcccatgttggaggcagaagggaccctagccatccacctccaggttattgcagagcaagaatgaaacctaagcttctgactccagatttagggccttttctttgacctcatctgatcgtcccaaactctgcagatctggaccacacccagaccttcccactggccttgcccgtggcctcccctagatggctgtgacatgtctccaccatgcagctgagcctttgagahcctgaggcacatgtcacaggtcccacctcacctcagggtctagggtgggagtgctgggcttgggggtgagtaagatctacttcttcctctttgctttgcatcccatacagatgctccctgctgtattcaagctgagaaaagcctaacacatcctcaaagtctttttctttgtaactatttctagatgcactcaacgtcccatctacttgctgcttcacatttagcagtaagaagatctccttgcagaggctgaagagctatgtgatcaccaccagcaggtgtccccagaaggctgtcatgtgggtagaaaaatccctgctcgcctggctcctccccactcccacattccccaatccaaagttctgccccaggagacagacgtcagactgacttgagatcttaggatgagatctagccagactgtgtgatgcaaaatcctccaattttggctgcacaacaggtccaaagaggacctataatttcccacaccttgtttcctggatgggcaccagcccacaccctttagcagatgccaggatcagtttcccaggggcagcaagagcagtggctgcctccagagaccccttctgtccacacacctcctacttcctgtcctggaggggtgccccttcacctgtagtaggtggaccaggcaggtttagaacccagtgtgtcatctcctaggtaaaccctcaaagggttccatctaactgtgccagatctccttcctccacagcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggtttgtattcggttcccaggggttgagc

SEQ ID NO: 2734 - DNA, 855 bp; single-stranded, linear
ggcaaagaaacattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctatagcaaggccttgagcaagtaggttgctgtctctaagcccccttcccttccactatgagctgctggcagtgggtttgtattcggttcccaggggttgagagcatgcctgtgggagtcatggacatgaagggatgccgcaatgtaggaaggagagctctttgtgaatgtgaggtgttgctaaatatgttattgtggaaagatgaatgcaatagtaggactgctgacattttgcagaaaatacattttatttaaaaatctcctaaaaaaaaaaaaaaaaaaaaaaaagaaaaaaaaaaaa

SEQ ID NO: 2735 - DNA, 825 bp; single-stranded, linear
acattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggttgtattcggttcccaggggttgagagcatgcctgtgggagtcatggacatgaagggatgctgcaatgtaggaaggagagctctttgtgaatgtgaggttgttgctaaattattgtttattgtggaaagatgaatgcaatagtaggactgctgacattttgcagaaaatacattttatttaaaatctcctaaaaaaaaaaaaaa

SEQ ID NO: 2736 - DNA, 860 bp; single-stranded, linear
aaaaggccggcggaacagccagaggagcagagaggcaaagaaacattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggtttgtattcggttcccaggggttgagagcatgcctgtgggagtcatggacatgaagggatgctgcaatgtaggaaggagagctctttgtgaatgtgaggtgttgctaaatatgttattgtggaaagatgaatgcaatagtaggactgctgacattttgcagaaaatacattttatttaaaatctccaaaaaaaaaaa

SEQ ID NO: 2737 - DNA, 5700 bp; single-stranded, linear
aattaaccctcactaaagggagtcgactcgatccccccgcctcagccccttttttcttttttttttcattttcagttcaggagagttttagcttaattataggctacagaaccagctttgggcttcatctatcctttctaatatttactgtttcctatttctctaatcctagctctttatttcttccctttactttcactgggcttattttgctatagtggaatgcagagggatgagtattccaggaaggcacaaaaactgtgccaagtcttggagctagggatgagtgggaaagggacatgttcaaccattttaggccattccctccccacctcccagctcccagatatgtgcccctcgcaggaggagcccaggaatgggccaaacacctcacttctttgctctgagggccaccccagccctcccatcaacagctctagaaacccaatggtccttcctggaaacacggggcctgcatcaatcagaggtgtttgaaccatgtccctctgggcctgaggggcagaaggggacacaatatgtaatgtaaggagcccctgtcatcagaaatctgacttaatctgttttcagatattagacttccacataaaagttgacttggaaaaagacttctgctgctaaacaaaagttgaaactgccttggtgataaaatataagcagaccagctttctcttctagctttccctctcatttcccataagattttggtcaagttatttaatctctctgcatccgtttcctcttctatgaaatgggcatgataataatggtatatacctcctcaaggggggtataacgtgaacagagtccttagcacagcactctgtctctacgggagtgaattttcattgtttttctctttcctgttggagaaagtaagaagaaaacagcgcctttatggcttcccatggtgaatggctggggcgcgtctgtgtccctgtctcctctctggctccttgtggcctgaacagccagaaggaagccatgccatgctgtttcagccctcagcttccctcttgcatttcctagaaaagtctttggtgcccagctccagctcagcagattcaggatcccccttcatcatgacttggtcaacgccctgctcaggccaaggtcctctgagagttccaagcttctccactccctataaaaggccggcggaacagccagaggagcagagaggcaaagaaacattgtgaaatctccaactcttaaccttcaacatgaaagtctctgcagtgcttctgtgcctgctgctcatgacagcagctttcaacccccagggacttgctcagccaggtaagtcacctcccttcgactctccctctctttccctctgtttctctattcaaggaagacctaagcccgagtgctcctccactttttttttagattgagtctcattatgttgcccaggctgaagtgcaggggtgcgatcttggctcattgcaaccttcacctcccaggttcaagcgattctcttgcctcagccttctgagtagctgtgattacaggcaccgccatcacgtgcagctaatttttgtatttttagtagagaaggggtttcactatgttggccaggctggtctcaaactcttgacctcaagtgatcctcccgtctcggcctcccaaagtgctgggattacaggcgtgagcaccaggcccagccaagtgccccacttctaagcccaccagaatagtaaggctcctcagaggttcactttaacatctaattttaaagatagaaagctgaagcccatgttggaggcagaagggaccctagccatccacctccaggttattgcagagcaagaatgaaacctaagcttctgactccagatttagggccttttctttgacctcatctgatcgtcccaaactctgcagatctggaccacacccagaccttcccactggccttgcccgtggcctcccctagatggctgtgacatgtctccaccatgcagctgagcctttgagahcctgaggcacatgtcacaggtcccacctcacctcagggtctagggtgggagtgctgggcttgggggtgagtaagatctacttcttcctctttgctttgcatcccatacagatgctccctgctgtattcaagctgagaaaagcctaacacatcctcaaagtctttttctttgtaactatttctagatgcactcaacgtcccatctacttgctgcttcacatttagcagtaagaagatctccttgcagaggctgaagagctatgtgatcaccaccagcaggtgtccccagaaggctgtcatgtgggtagaaaaatccctgctcgcctggctcctccccactcccacattccccaatccaaagttctgccccaggagacagacgtcagactgacttgagatcttaggatgagatctagccagactgtgtgatgcaaaatcctccaattttggctgcacaacaggtccaaagaggacctataatttcccacaccttgtttcctggatgggcaccagcccacaccctttagcagatgccaggatcagtttcccaggggcagcaagagcagtggctgcctccagagaccccttctgtccacacacctcctacttcctgtcctggaggggtgccccttcacctgtagtaggtggaccaggcaggtttagaacccagtgtgtcatctcctaggtaaaccctcaaagggttccatctaactgtgccagatctccttcctccacagcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggtttgtattcggttcccaggggttgagcggcaaagaaacattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctatagcaaggccttgagcaagtaggttgctgtctctaagcccccttcccttccactatgagctgctggcagtgggtttgtattcggttcccaggggttgagagcatgcctgtgggagtcatggacatgaagggatgccgcaatgtaggaaggagagctctttgtgaatgtgaggtgttgctaaatatgttattgtggaaagatgaatgcaatagtaggactgctgacattttgcagaaaatacattttatttaaaaatctcctaaaaaaaaaaaaaaaaaaaaaaaagaaaaaaaaaaaaacattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggttgtattcggttcccaggggttgagagcatgcctgtgggagtcatggacatgaagggatgctgcaatgtaggaaggagagctctttgtgaatgtgaggttgttgctaaattattgtttattgtggaaagatgaatgcaatagtaggactgctgacattttgcagaaaatacattttatttaaaatctcctaaaaaaaaaaaaaaaaaaggccggcggaacagccagaggagcagagaggcaaagaaacattgtgaaatctccaactcttaaccttcaacatgaaagtctctgcagtgcttctgtgcctgctgctcatgacagcagctttcaacccccagggacttgctcagccagatgcactcaacgtcccatctacttgctgcttcacatttagcagtaagaagatctccttgcagaggctgaagagctatgtgatcaccaccagcaggtgtccccagaaggctgtcatcttcagaaccaaactgggcaaggagatctgtgctgacccaaaggagaagtgggtccagaattatatgaaacacctgggccggaaagctcacaccctgaagacttgaactctgctacccctactgaaatcaagctggagtacgtgaaatgacttttccattctcctctggcctcctcttctatgctttggaatacttctaccataattttcaaataggatgcattcggttttgtgattcaaaatgtactatgtgttaagtaatattggctattatttgacttgttgctggtttggagtttatttgagtattgctgatcttttctaaagcaaggccttgagcaagtaggttgctgtctctaagcccccttcccttccactatgagctgctggcagtgggtttgtattcggttcccaggggttgagagcatgcctgtgggagtcatggacatgaagggatgctgcaatgtaggaaggagagctctttgtgaatgtgaggtgttgctaaatatgttattgtggaaagatgaatgcaatagtaggactgctgacattttgcagaaaatacattttatttaaaatctccaaaaaaaaaaa

SEQ ID NO: 2738 - DNA, 2248 bp; single-stranded, linear
cgcccgggcaggtcctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcccgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctggggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaataggtcagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataagaaaaaaaaaa

SEQ ID NO: 2739 - DNA, 627 bp; single-stranded, linear
ggagaccggccgcatggacccagggacagtggccaccatgcgtaagccccgctgctccctgcctgacgtgctgggggtggcggggctggtcaggcggcgtcgccggtacgctctgagcggcagcgtgtggaagaagcgaaccctgacatggagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaagcctctcagcagctggagcaggagctggcaggcggctcaccggttgatgaggagctgggcttcagccggggctggcgtgtgaatcctctgggtcctggcagtcctgagcgcctgagctgaatacagagggaagaggctgggagcaaggccgggtgctggggccggcaggctgtgttctgaga

SEQ ID NO: 2740 - DNA, 1532 bp; single-stranded, linear
atgatcttactcacattcagcactggaagacggttggatttcgtgcatcattcgggggtgtttttcttgcaaaccttgctttggattttatgtgctacagtctgcggaacggagcagtatttcaatgtggaggtttggttacaaaagtacggctaccttccaccgactgaccccagaatgtcagtgctgcgctctgcagagaccatgcagtctgccctagctgccatgcagcagttctatggcattaacatgacaggaaaagtggacagaaacacaattgactggatgaagaagccccgatgcggtgtacctgaccagacaagaggtagctccaaatttcatattcgtcgaaagcgatatgcattgacaggacagaaatggcagcacaagcacatcacttacagtataaagaacgtaactccaaaagtaggagaccctgagactcgtaaagctattcgccgtgcctttgatgtgtggcagaatgtaactcctctgacatttgaagaagttccctacagtgaattagaaaatggcaaacgtgatgtggatataaccattatttttgcatctggtttccatggggacagctctccctttgatggagagggaggatttttggcacatgcctacttccctggaccaggaattggaggagatacccattttgactcagatgagccatggacactaggaaatcctaatcatgatggaaatgacttatttcttgtagcagtccatgaactgggacatgctctgggattggagcattccaatgaccccactgccatcatggctccattttaccagtacatggaaacagacaacttcaaactacctaatgatgatttacagggcatccagaagatatatggtccacctgacaagattcctccacctacaagacctctaccgacagtgcccccacaccgctctattcctccggctgacccaaggaaaaatgacaggccaaaacctcctcggcctccaaccggcagaccctcctatcccggagccaaacccaacatctgtgatgggaactttaacactctagctattcttcgtcgtgagatgtttgttttcaaggaccagtggttttggcgagtgagaaacaacagggtgatggatggatacccaatgcaaattacttacttctggcggggcttgcctcctagtatcgatgcagtttatgaaaatagcgacgggaattttgtgttctttaaagtgaagggagacactctatctgtaatccaagatggttggctctacaaataccattggaaatggattctagaacaaaggcagtcagtgcctgtgctctcaagacaaactgaaaagcacaagacctatgaagaattatcttccatcacatactaacaaagaacaatcaggaattgaaaatttaaaataaaaggccatttacaattgcattcgaaaacaccaaataccgagggatcaatctgcaaaaaatgtgcatgacctctacattgaaaacaacaaaacactactaaatgtttgtctttaaaggcagctgg

SEQ ID NO: 2741 - DNA, 1778 bp; single-stranded, linear
tagaagtttacaatgaagtttcttctaatactgctcctgcaggccactgcttctggagctcttcccctgaacagctctacaagcctggaaaaaaataatgtgctatttggtgagagatacttagaaaaattttatggccttgagataaacaaacttccagtgacaaaaatgaaatatagtggaaacttaatgaaggaaaaaatccaagaaatgcagcacttcttgggtctgaaagtgaccgggcaactggacacatctaccctggagatgatgcacgcacctcgatgtggagtccccgatctccatcatttcagggaaatgccaggggggcccgtatggaggaaacattatatcacctacagaatcaataattacacacctgacatgaaccgtgaggatgttgactacgcaatccggaaagctttccaagtatggagtaatgttacccccttgaaattcagcaagattaacacaggcatggctgacattttggtggtttttgcccgtggagctcatggagacttccatgcttttgatggcaaaggtggaatcctagcccatgcttttggacctggatctggcattggaggggatgcacatttcgatgaggacgaattctggactacacattcaggaggcacaaacttgttcctcactgctgttcacgagattggccattccttaggtcttggccattctagtgatccaaaggctgtaatgttccccacctacaaatatgtcgacatcaacacatttcgcctctctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcaatttaagaccagagccaaattatcccaagagcatacattcttttggttttcctaactttgtgaaaaaaattgatgcagctgtttttaacccacgtttttataggacctacttctttgtagataaccagtattggaggtatgatgaaaggagacagatgatggaccctggttatcccaaactgattaccaagaacttccaaggaatcgggcctaaaattgatgcagtcttctattctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaagcaagataattctatttgaagcatgctctgtaagttgcttcctaacatccttggactgagaaattatacttacttctggcataactaaaattaagtatatatattttggctcaaataaaattg

SEQ ID NO: 2742 - DNA, 1743 bp; single-stranded, linear
aaagaaggtaagggcagtgagaatgatgcatcttgcattccttgtgctgttgtgtctgccagtctgctctgcctatcctctgagtggggcagcaaaagaggaggactccaacaaggatcttgcccagcaatacctagaaaagtactacaacctcgaaaaggatgtgaaacagtttagaagaaaggacagtaatctcattgttaaaaaaatccaaggaatgcagaagttccttgggttggaggtgacagggaagctagacactgacactctggaggtgatgcgcaagcccaggtgtggagttcctgacgttggtcacttcagctcctttcctggcatgccgaagtggaggaaaacccaccttacatacaggattgtgaattatacaccagatttgccaagagatgctgttgattctgccattgagaaagctctgaaagtctgggaagaggtgactccactcacattctccaggctgtatgaaggagaggctgatataatgatctctttcgcagttaaagaacatggagacttttactcttttgatggcccaggacacagtttggctcatgcctacccacctggacctgggctttatggagatattcactttgatgatgatgaaaaatggacagaagatgcatcaggcaccaatttattcctcgttgctgctcatgaacttggccactccctggggctctttcactcagccaacactgaagctttgatgtacccactctacaactcattcacagagctcgcccagttccgcctttcgcaagatgatgtgaatggcattcagtctctctacggacctccccctgcctctactgaggaacccctggtgcccacaaaatctgttccttcgggatctgagatgccagccaagtgtgatcctgctttgtccttcgatgccatcagcactctgaggggagaatatctgttctttaaagacagatatttttggcgaagatcccactggaaccctgaacctgaatttcatttgatttctgcattttggccctctcttccatcatatttggatgctgcatatgaagttaacagcagggacaccgtttttatttttaaaggaaatgagttctgggccatcagaggaaatgaggtacaagcaggttatccaagaggcatccataccctgggttttcctccaaccataaggaaaattgatgcagctgtttctgacaaggaaaagaagaaaacatacttctttgcagcggacaaatactggagatttgatgaaaatagccagtccatggagcaaggcttccctagactaatagctgatgactttccaggagttgagcctaaggttgatgctgtattacaggcatttggatttttctacttcttcagtggatcatcacagtttgagtttgaccccaatgccaggatggtgacacacatattaaagagtaacagctggttacattgctaggcgagatagggggaagacagatatgggtgtttttaataaatctaataattattcatctaatgtattatgagccaaaatggttaatttttcctgcatgttctgtgactgaagaagatgagccttgcagatatctgcatgtgtcatgaagaatgtttctggaattcttcacttgcttttgaattgcactgaacagaattaagaaatactcatgtgcaataggtgagagaatgtattttcatagatgtgttattacttcctcaataaaaagttttattttgggcctgttcctt

SEQ ID NO: 2743 - DNA, 1209 bp; single-stranded, linear
ctgaggtgggtaagagtacaatggctaaatcttaacacactcttacgtgtacaccctaccgtacaccatccagactcgtccccatacaatcaggagtgatcagtacgtaaatgcttatggtgtgatttgaaggggtgttagagtagatcatctctcacaccgcagcagcactgcttccaattcatcctttggaattttattccctgactgttaaaagtttttagtgcttaaatattctctattgaggtaagagacagattctgtgcaatgggacaattaggtcaagagggaaagaagctgaggtgataggcagatagattccagaggcaaacttttcccatctgctaaagttgaaaagagtaacccacatcctaccaacgctagacaatctaggatgtagggaaagtttgtctctggaatctatccaggtacccagttgggactgagcttcagcttagatgtctgaagatgttaagttatagaatcaggtttaagtctgaagatgttaagttatagaatcaggatctgagccggtacaacacgtggataaacaatgaagtcgatgttacaaatttttttttgctacttgtaaaatctctgtatcacatttctctagggagctggattccgtttaggagcactcatttactccaggaaaaggattttatttaatctttcaacatttactttaaaaactttttttatctataatgaatataaggaagtattataatgaaaaccaagttatcaggctttaagaaaatatattttaagttctccttctcttttagttgcttgatatttcttttacaagggcttattttgtagataggtggacgtagaggcttatttatcattttgaaggtacatactctgaattgcttgagtgatggactagatgctaattgatccattgtcgtctgaataaagtcatgcttttgtttgcatgtttttagagatagtcaagggatgatatcaactatgagtcactcataggattcatattcacagaacccggactaagggctatataaagaggaacagttcaggaacttaggctagaaaggacacagtaaactgaattgatccgtttagaagtttacaatgaagtttcttctaatactgctcctgcaggccactgcttctggagctcttcccctgaacagctctacaagcctggaaaaaaataatgtgctattgggtgagaga

SEQ ID NO: 2744 - DNA, 9137 bp; single-stranded, linear
cgcccgggcaggtcctctgcctagcactgctcccccaaggctcccagaaatctcaggtcagaggcacggacagcctctggagctctcgtctggtgggaccatgaactgccagcagctgtggctgggcttcctactccccatgacagtctcaggccgggtcctggggcttgcagaggtggcgcccgtggactacctgtcacaatatgggtacctacagaagcctctagaaggatctaataacttcaagccagaagatatcaccgaggctctgagagcttttcaggaagcatctgaacttccagtctcaggtcagctggatgatgccacaagggcccgcatgaggcagcctcgttgtggcctagaggatcccttcaaccagaagacccttaaatacctgttgctgggccgctggagaaagaagcacctgactttccgcatcttgaacctgccctccacccttccaccccacacagcccgggcagccctgcgtcaagccttccaggactggagcaatgtggctcccttgaccttccaagaggtgcaggctggtgcggctgacatccgcctctccttccatggccgccaaagctcgtactgttccaatacttttgatgggcctgggagagtcctggcccatgccgacatcccagagctgggcagtgtgcacttcgacgaagacgagttctggactgaggggacctaccgtggggtgaacctgcgcatcattgcagcccatgaagtgggccatgctctggggcttgggcactcccgatattcccaggccctcatggccccagtctacgagggctaccggccccactttaagctgcacccagatgatgtggcagggatccaggctctctatggcaagaagagtccagtgataagggatgaggaagaagaagagacagagctgcccactgtgcccccagtgcccacagaacccagtcccatgccagacccttgcagtagtgaactggatgccatgatgctggggccccgtgggaagacctatgctttcaagggggactatgtgtggactgtatcagattcaggaccgggccccttgttccgagtgtctgccctttgggaggggctccccggaaacctggatgctgctgtctactcgcctcgaacacaatggattcacttctttaagggagacaaggtgtggcgctacattaatttcaagatgtctcctggcttccccaagaagctgaataggtcagaacctaacctggatgcagctctctattggcctctcaaccaaaaggtgttcctctttaagggctccgggtactggcagtgggacgagctagcccgaactgacttcagcagctaccccaaaccaatcaagggtttgtttacgggagtgccaaaccagccctcggctgctatgagttggcaagatggccgagtctacttcttcaagggcaaagtctactggcgcctcaaccagcagcttcgagtagagaaaggctatcccagaaatatttcccacaactggatgcactgtcgtccccggactatagacactaccccatcaggtgggaataccactccctcaggtacgggcataaccttggataccactctctcagccacagaaaccacgtttgaatactgactgctcacccacagacacaatcttggacattaacccctgaggctccaccacccaccctttcatttcccccccagaagcctaaggcctaatagctgaatgaaatacctgtctgctcagtagaaccttgcaggtgctgtagcaggcgcaagaccgtagatctcaggcctctaacacttccaactccagccaccactttcctgtgcattttcactcctgagaagtgctcccctaactcagatcccctaacttagatttggcccccaactccatttcctgtctgtcttagacagcccttccaactgtgtcatctcttctctggaggtcaatggtggagggagatgcctgggtcctgttcttcctacataaaatgcaagaaaacagcatggccagtaaactgagcaagggccttggaatccttgagaatcacatttatgtgcttatgattacgggcaagctaattaaccttgttgaatctcagattccccatttgcaacattaggttaagaccagtactgcaggattgttgcactaaatgaaatactgtatgtgaagtgcctggcacagtgtctggtacatttgtgtttaataaaagctaactccatgttcataagaaaaaaaaaaggagaccggccgcatggacccagggacagtggccaccatgcgtaagccccgctgctccctgcctgacgtgctgggggtggcggggctggtcaggcggcgtcgccggtacgctctgagcggcagcgtgtggaagaagcgaaccctgacatggagggtacgttccttcccccagagctcccagctgagccaggagaccgtgcgggtcctcatgagctatgccctgatggcctggggcatggagtcaggcctcacatttcatgaggtggattccccccagggccaggagcccgacatcctcatcgactttgcccgcgccttccaccaggacagctaccccttcgacgggttggggggcaccctagcccatgccttcttccctggggagcaccccatctccggggacactcactttgacgatgaggagacctggacttttgggtcaaaagcctctcagcagctggagcaggagctggcaggcggctcaccggttgatgaggagctgggcttcagccggggctggcgtgtgaatcctctgggtcctggcagtcctgagcgcctgagctgaatacagagggaagaggctgggagcaaggccgggtgctggggccggcaggctgtgttctgagaatgatcttactcacattcagcactggaagacggttggatttcgtgcatcattcgggggtgtttttcttgcaaaccttgctttggattttatgtgctacagtctgcggaacggagcagtatttcaatgtggaggtttggttacaaaagtacggctaccttccaccgactgaccccagaatgtcagtgctgcgctctgcagagaccatgcagtctgccctagctgccatgcagcagttctatggcattaacatgacaggaaaagtggacagaaacacaattgactggatgaagaagccccgatgcggtgtacctgaccagacaagaggtagctccaaatttcatattcgtcgaaagcgatatgcattgacaggacagaaatggcagcacaagcacatcacttacagtataaagaacgtaactccaaaagtaggagaccctgagactcgtaaagctattcgccgtgcctttgatgtgtggcagaatgtaactcctctgacatttgaagaagttccctacagtgaattagaaaatggcaaacgtgatgtggatataaccattatttttgcatctggtttccatggggacagctctccctttgatggagagggaggatttttggcacatgcctacttccctggaccaggaattggaggagatacccattttgactcagatgagccatggacactaggaaatcctaatcatgatggaaatgacttatttcttgtagcagtccatgaactgggacatgctctgggattggagcattccaatgaccccactgccatcatggctccattttaccagtacatggaaacagacaacttcaaactacctaatgatgatttacagggcatccagaagatatatggtccacctgacaagattcctccacctacaagacctctaccgacagtgcccccacaccgctctattcctccggctgacccaaggaaaaatgacaggccaaaacctcctcggcctccaaccggcagaccctcctatcccggagccaaacccaacatctgtgatgggaactttaacactctagctattcttcgtcgtgagatgtttgttttcaaggaccagtggttttggcgagtgagaaacaacagggtgatggatggatacccaatgcaaattacttacttctggcggggcttgcctcctagtatcgatgcagtttatgaaaatagcgacgggaattttgtgttctttaaagtgaagggagacactctatctgtaatccaagatggttggctctacaaataccattggaaatggattctagaacaaaggcagtcagtgcctgtgctctcaagacaaactgaaaagcacaagacctatgaagaattatcttccatcacatactaacaaagaacaatcaggaattgaaaatttaaaataaaaggccatttacaattgcattcgaaaacaccaaataccgagggatcaatctgcaaaaaatgtgcatgacctctacattgaaaacaacaaaacactactaaatgtttgtctttaaaggcagctggtagaagtttacaatgaagtttcttctaatactgctcctgcaggccactgcttctggagctcttcccctgaacagctctacaagcctggaaaaaaataatgtgctatttggtgagagatacttagaaaaattttatggccttgagataaacaaacttccagtgacaaaaatgaaatatagtggaaacttaatgaaggaaaaaatccaagaaatgcagcacttcttgggtctgaaagtgaccgggcaactggacacatctaccctggagatgatgcacgcacctcgatgtggagtccccgatctccatcatttcagggaaatgccaggggggcccgtatggaggaaacattatatcacctacagaatcaataattacacacctgacatgaaccgtgaggatgttgactacgcaatccggaaagctttccaagtatggagtaatgttacccccttgaaattcagcaagattaacacaggcatggctgacattttggtggtttttgcccgtggagctcatggagacttccatgcttttgatggcaaaggtggaatcctagcccatgcttttggacctggatctggcattggaggggatgcacatttcgatgaggacgaattctggactacacattcaggaggcacaaacttgttcctcactgctgttcacgagattggccattccttaggtcttggccattctagtgatccaaaggctgtaatgttccccacctacaaatatgtcgacatcaacacatttcgcctctctgctgatgacatacgtggcattcagtccctgtatggagacccaaaagagaaccaacgcttgccaaatcctgacaattcagaaccagctctctgtgaccccaatttgagttttgatgctgtcactaccgtgggaaataagatctttttcttcaaagacaggttcttctggctgaaggtttctgagagaccaaagaccagtgttaatttaatttcttccttatggccaaccttgccatctggcattgaagctgcttatgaaattgaagccagaaatcaagtttttctttttaaagatgacaaatactggttaattagcaatttaagaccagagccaaattatcccaagagcatacattcttttggttttcctaactttgtgaaaaaaattgatgcagctgtttttaacccacgtttttataggacctacttctttgtagataaccagtattggaggtatgatgaaaggagacagatgatggaccctggttatcccaaactgattaccaagaacttccaaggaatcgggcctaaaattgatgcagtcttctattctaaaaacaaatactactatttcttccaaggatctaaccaatttgaatatgacttcctactccaacgtatcaccaaaacactgaaaagcaatagctggtttggttgttagaaatggtgtaattaatggtttttgttagttcacttcagcttaataagtatttattgcatatttgctatgtcctcagtgtaccactacttagagatatgtatcataaaaataaaatctgtaaaccataggtaatgattatataaaatacataatatttttcaattttgaaaactctaattgtccattcttgcttgactctactattaagtttgaaaatagttaccttcaaagcaagataattctatttgaagcatgctctgtaagttgcttcctaacatccttggactgagaaattatacttacttctggcataactaaaattaagtatatatattttggctcaaataaaattgaaagaaggtaagggcagtgagaatgatgcatcttgcattccttgtgctgttgtgtctgccagtctgctctgcctatcctctgagtggggcagcaaaagaggaggactccaacaaggatcttgcccagcaatacctagaaaagtactacaacctcgaaaaggatgtgaaacagtttagaagaaaggacagtaatctcattgttaaaaaaatccaaggaatgcagaagttccttgggttggaggtgacagggaagctagacactgacactctggaggtgatgcgcaagcccaggtgtggagttcctgacgttggtcacttcagctcctttcctggcatgccgaagtggaggaaaacccaccttacatacaggattgtgaattatacaccagatttgccaagagatgctgttgattctgccattgagaaagctctgaaagtctgggaagaggtgactccactcacattctccaggctgtatgaaggagaggctgatataatgatctctttcgcagttaaagaacatggagacttttactcttttgatggcccaggacacagtttggctcatgcctacccacctggacctgggctttatggagatattcactttgatgatgatgaaaaatggacagaagatgcatcaggcaccaatttattcctcgttgctgctcatgaacttggccactccctggggctctttcactcagccaacactgaagctttgatgtacccactctacaactcattcacagagctcgcccagttccgcctttcgcaagatgatgtgaatggcattcagtctctctacggacctccccctgcctctactgaggaacccctggtgcccacaaaatctgttccttcgggatctgagatgccagccaagtgtgatcctgctttgtccttcgatgccatcagcactctgaggggagaatatctgttctttaaagacagatatttttggcgaagatcccactggaaccctgaacctgaatttcatttgatttctgcattttggccctctcttccatcatatttggatgctgcatatgaagttaacagcagggacaccgtttttatttttaaaggaaatgagttctgggccatcagaggaaatgaggtacaagcaggttatccaagaggcatccataccctgggttttcctccaaccataaggaaaattgatgcagctgtttctgacaaggaaaagaagaaaacatacttctttgcagcggacaaatactggagatttgatgaaaatagccagtccatggagcaaggcttccctagactaatagctgatgactttccaggagttgagcctaaggttgatgctgtattacaggcatttggatttttctacttcttcagtggatcatcacagtttgagtttgaccccaatgccaggatggtgacacacatattaaagagtaacagctggttacattgctaggcgagatagggggaagacagatatgggtgtttttaataaatctaataattattcatctaatgtattatgagccaaaatggttaatttttcctgcatgttctgtgactgaagaagatgagccttgcagatatctgcatgtgtcatgaagaatgtttctggaattcttcacttgcttttgaattgcactgaacagaattaagaaatactcatgtgcaataggtgagagaatgtattttcatagatgtgttattacttcctcaataaaaagttttattttgggcctgttccttctgaggtgggtaagagtacaatggctaaatcttaacacactcttacgtgtacaccctaccgtacaccatccagactcgtccccatacaatcaggagtgatcagtacgtaaatgcttatggtgtgatttgaaggggtgttagagtagatcatctctcacaccgcagcagcactgcttccaattcatcctttggaattttattccctgactgttaaaagtttttagtgcttaaatattctctattgaggtaagagacagattctgtgcaatgggacaattaggtcaagagggaaagaagctgaggtgataggcagatagattccagaggcaaacttttcccatctgctaaagttgaaaagagtaacccacatcctaccaacgctagacaatctaggatgtagggaaagtttgtctctggaatctatccaggtacccagttgggactgagcttcagcttagatgtctgaagatgttaagttatagaatcaggtttaagtctgaagatgttaagttatagaatcaggatctgagccggtacaacacgtggataaacaatgaagtcgatgttacaaatttttttttgctacttgtaaaatctctgtatcacatttctctagggagctggattccgtttaggagcactcatttactccaggaaaaggattttatttaatctttcaacatttactttaaaaactttttttatctataatgaatataaggaagtattataatgaaaaccaagttatcaggctttaagaaaatatattttaagttctccttctcttttagttgcttgatatttcttttacaagggcttattttgtagataggtggacgtagaggcttatttatcattttgaaggtacatactctgaattgcttgagtgatggactagatgctaattgatccattgtcgtctgaataaagtcatgcttttgtttgcatgtttttagagatagtcaagggatgatatcaactatgagtcactcataggattcatattcacagaacccggactaagggctatataaagaggaacagttcaggaacttaggctagaaaggacacagtaaactgaattgatccgtttagaagtttacaatgaagtttcttctaatactgctcctgcaggccactgcttctggagctcttcccctgaacagctctacaagcctggaaaaaaataatgtgctattgggtgagaga

SEQ ID NO: 2745 - DNA, 776 bp; single-stranded, linear
aaggacacgggcagcagacagtggtcagtcctttcttggctctgctgacactcgagcccacattccgtcacctgctcagaatcatgcaggtctccactgctgcccttgctgtcctcctctgcaccatggctctctgcaaccagttctctgcatcacttgctgctgacacgccgaccgcctgctgcttcagctacacctcccggcagattccacagaatttcatagctgactactttgagacgagcagccagtgctccaagcccggtgtcatcttcctaaccaagcgaagccggcaggtctgtgctgaccccagtgaggagtgggtccagaaatatgtcagcgacctagagctgagtgcctgaggggtccagaagcttcgaggcccagcgacctcggtgggccagtggggaggagcaggagcctgagccttgggaaacatgcgtgtgacctccacagctacctcttctatggactggttgttgccaaacagccacactgtgggactcttcttaacttaaattttaatttatttatactatttagtttttgtaatttattttcgatttcacagtgtgtttgtgattgtttgctctgagagttcccctgtcccctcccccttccctcacaccgcgtctggtgacaaccgagtggctgtcatcagcctgtgtaggcagtcatggcaccaaagccaccagactgacaaatgtgtatcggatgcttttgttcagggctgtgatcggcctggggaaataataaagcacgctcttttaaaaggt

SEQ ID NO: 2746 - DNA, 4124 bp; single-stranded, linear
acagccttgaccttatgtcatgggttcaacttggacactgaaaacgcaatgaccttccaagagaacgcaaggggcttcgggcagagcgtggtccagcttcagggatccagggtggtggttggagccccccaggagatagtggctgccaaccaaaggggcagcctctaccagtgcgactacagcacaggctcatgcgagcccatccgcctgcaggtccccgtggaggccgtgaacatgtccctgggcctgtccctggcagccaccaccagcccccctcagctgctggcctgtggtcccaccgtgcaccagacttgcagtgagaacacgtatgtgaaagggctctgcttcctgtttggatccaacctacggcagcagccccagaagttcccagaggccctccgagggtgtcctcaagaggatagtgacattgccttcttgattgatggctctggtagcatcatcccacatgactttcggcggatgaaggagtttgtctcaactgtgatggagcaattaaaaaagtccaaaaccttgttctctttgatgcagtactctgaagaattccggattcactttaccttcaaagagttccagaacaaccctaacccaagatcactggtgaagccaataacgcagctgcttgggcggacacacacggccacgggcatccgcaaagtggtacgagagctgtttaacatcaccaacggagcccgaaagaatgcctttaagatcctagttgtcatcacggatggagaaaagtttggcgatcccttgggatatgaggatgtcatccctgaggcagacagagagggagtcattcgctacgtcattggggtgggagatgccttccgcagtgagaaatcccgccaagagcttaataccatcgcatccaagccgcctcgtgatcacgtgttccaggtgaataactttgaggctctgaagaccattcagaaccagcttcgggagaagatctttgcgatcgagggtactcagacaggaagtagcagctcctttgagcatgagatgtctcaggaaggcttcagcgctgccatcacctctaatggccccttgctgagcactgtggggagctatgactgggctggtggagtctttctatatacatcaaaggagaaaagcaccttcatcaacatgaccagagtggattcagacatgaatgatgcttacttgggttatgctgccgccatcatcttacggaaccgggtgcaaagcctggttctgggggcacctcgatatcagcacatcggcctggtagcgatgttcaggcagaacactggcatgtgggagtccaacgctaatgtcaagggcacccagatcggcgcctacttcggggcctccctctgctccgtggacgtggacagcaacggcagcaccgacctggtcctcatcggggccccccattactacgagcagacccgagggggccaggtgtccgtgtgccccttgcccagggggcagagggctcggtggcagtgtgatgctgttctctacggggagcagggccaaccctggggccgctttggggcagccctaacagtgctgggggacgtaaatggggacaagctgacggacgtggccattggggccccaggagaggaggacaaccggggtgctgtttacctgtttcacggaacctcaggatctggcatcagcccctcccatagccagcggatagcaggctccaagctctctcccaggctccagtattttggtcagtcactgagtgggggccaggacctcacaatggatggactggtagacctgactgtaggagcccaggggcacgtgctgctgctcaggtcccagccagtactgagagtcaaggcaatcatggagttcaatcccagggaagtggcaaggaatgtatttgagtgtaatgatcaggtggtgaaaggcaaggaagccggagaggtcagagtctgcctccatgtccagaagagcacacgggatcggctaagagaaggacagatccagagtgttgtgacttatgacctggctctggactccggccgcccacattcccgcgccgtcttcaatgagacaaagaacagcacacgcagacagacacaggtcttggggctgacccagacttgtgagaccctgaaactacagttgccgaattgcatcgaggacccagtgagccccattgtgctgcgcctgaacttctctctggtgggaacgccattgtctgctttcgggaacctccggccagtgctggcggaggatgctcagagactcttcacagccttgtttccctttgagaagaattgtggcaatgacaacatctgccaggatgacctcagcatcaccttcagtttcatgagcctggactgcctcgtggtgggtgggccccgggagttcaacgtgacagtgactgtgagaaatgatggtgaggactcctacaggacacaggtcaccttcttcttcccgcttgacctgtcctaccggaaggtgtccacgctccagaaccagcgctcacagcgatcctggcgcctggcctgtgagtctgcctcctccaccgaagtgtctggggccttgaagagcaccagctgcagcataaaccaccccatcttcccggaaaactcagaggtcacctttaatatcacgtttgatgtagactctaaggcttcccttggaaacaaactgctcctcaaggccaatgtgaccagtgagaacaacatgcccagaaccaacaaaaccgaattccaactggagctgccggtgaaatatgctgtctacatggtggtcaccagccatggggtctccactaaatatctcaacttcacggcctcagagaataccagtcgggtcatgcagcatcaatatcaggtcagcaacctggggcagaggagcctccccatcagcctggtgttcttggtgcccgtccggctgaaccagactgtcatatgggaccgcccccaggtcaccttctccgagaacctctcgagtacgtgccacaccaaggagcgcttgccctctcactccgactttctggctgagcttcggaaggcccccgtggtgaactgctccatcgctgtctgccagagaatccagtgtgacatcccgttctttggcatccaggaagaattcaatgctaccctcaaaggcaacctctcgtttgactggtacatcaagacctcgcataaccacctcctgatcgtgagcacagctgagatcttgtttaacgattccgtgttcaccctgctgccgggacagggggcgtttgtgaggtcccagacggagaccaaagtggagccgttcgaggtccccaaccccctgccgctcatcgtgggcagctctgtcgggggactgctgctcctggccctcatcaccgccgcgctgtacaagctcggcttcttcaagcggcaatacaaggacatgatgagtgaagggggtcccccgggggccgaaccccagtagcggctccttcccgacagagctgcctctcggtggccagcaggactctgcccagaccacacgtagcccccaggctgctggacacgtcggacagcgaagtatccccgacaggacgggcttgggcttccatttgtgtgtgtgcaagtgtgtatgtgcgtgtgtgcgagtgtgtgcaagtgtctgtgtgcaagtgtgtgcacgtgtcggtgtgcgtgcatgtgcactcgcacgcccatgtgtgagtgtgtgcaagtatgtgagtgtgtccaagtgtgtgtgcgtgtgtccatgtgtgtgcaagtgtgtgcatgtgtgcgagtgtgtgcatgtgtgtgctcaggggcgtgtggctcacgtgtgtgactcagatgtctctggcgtgtgggtaggtgacggccagcgtagcctctccggcagaagggaactgcctgggctcccttgtgcgtgggtgaagccgctgctgggttttcctccgggagaggggacggtcaatcctgtgggtgaagacagagggaaacacagcagcttctctccactgaaagaagtgggacttcccgtcgcctgcagcctgcggcctgctggagcctgcgcagcttggatggagactccatgagaagccgtgggtggaaccaggagcctcctccacaccagcgctgatgcccaataaagatgcccactgaggaatgatg

SEQ ID NO: 2747 - DNA, 2998 bp; single-stranded, linear
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtaatggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagcctcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatccccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgttaatgaaattatcaggaaggagttttcaggacctcctgccagaaatcagacgtaa

SEQ ID NO: 2748 - DNA, 3784 bp; single-stranded, linear
gctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgctgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagtttggtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtgggtgaccagattacaggtcagccttcgtctcagttacaacctattacatatggtccttcacattcagggtctgttacaacagcttccccagcagcttctcatcccttgggtagttcaccgctttctgggccaccatctcctcagtttcagcctatgccttaccaatctcctagctcaggaactggctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgaccaatttatatctgacttggaacaccagccatcaggttcagcagagaaatggcctaaccacagtgtgctctcatgtccagctcctttctggagaatctagaggtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactcttcaaccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttaaatgatgggtgctttgagtgtgaatccagcaggctctcttgtttccgaggtgctgcttttgcaggtgacctggttacttaactaggagtggtgatttgtactgctttatggtcatttgaagggccctttagtttttatgataatttttaaaataggaacttttgataagaccttctagaagcaa

SEQ ID NO: 2749 - DNA, 3769 bp; single-stranded, linear
gctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgctgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagtttggtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtgggtgaccagattacaggtcagccttcgtctcagttacaacctattacatatggtccttcacattcagggtctgttacaacagcttccccagcagcttctcatcccttgggtagttcaccgctttctgggccaccatctcctcagtttcagcctatgccttaccaatctcctagctcaggaactggctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgatttgtttaccagtaataattttgacttgcttcagttgagacctacgttttggccagtcccagcaggaagatatctgaggaatctagagtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactcttcaaccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttaaatgatgggtgctttgagtgtgaatccagcaggctctcttgtttccgaggtgctgcttttgcaggtgacctggttacttaactaggagtggtgatttgtactgctttatggtcatttgaagggccctttagtttttatgataatttttaaaataggaacttttgataagaccttctagaagcaa

SEQ ID NO: 2750 - DNA, 3583 bp; single-stranded, linear
gctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgctgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagtttggtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtgggtgaccagattacaggtcagccttcgtctcagttacaacctattacatatggtccttcacattcagggtctgttacaacagcttccccagcagcttctcatcccttgggtagttcaccgctttctgggccaccatctcctcagtttcagcctatgccttaccaatctcctagctcaggaactggctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatggtaagttcatctctgatatgttcttgaagtagtgaagattcagggactttattctcccaagtgtcatgaaaaagtttctatggattgcttattggcatatggttgggcttttaaataagttgttattagaaatatatgttaatatataactttgccaggtaccacggctcacgcctgtatcccagcactttggaaggctgaggcgggtggatcacaaggtcaggagttcaagaccagcctggccaacatggtgtaacgctgtctctactaaaaatacaaaaaattagccaggcatggtggtgtgtgactataatcccagctactcgggaggctgagacaggagaatcacttgaacccgggaggtggcagttgcagggagctaagatcgcgccattgcactccagcctgggcggcagagcaagactccgtctcgggaaaaaaaaaaaaaaaaaa

SEQ ID NO: 2751 - DNA, 2935 bp; single-stranded, linear
gaattccgggccgggagaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcctgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgagttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccatccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccgtttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcgcctggaggagaagtcatctcatgacaacagaagggaggtggccgggctgagcacggagacccaccgtgcaggggcctttcatgggaacggcccacacgcagtttgaccccacgcccagcccttctggcacccctggggttcaatactggaagtgccttatttaaccagaccatca

SEQ ID NO: 2752 - DNA, 17069 bp; single-stranded, linear
agcaggaagctcgcgccgccgtcgccgccgccgctcagcttccccgggcgcgtccaggacccgctgcgccaggcgcgccgtccccggacccggcgtgcgtccctacgaggaaagggaccccgccgctcgagccgcctccgccagccccactgcgaggggtcccagagccagccgcgcccgccctcgcccccggccccgcagccttcccgccctgcgcgccatgaacgcccccgagcggcagccccaacccgacggcggggacgccccaggccacgagcctgggggcagcccccaagacgagcttgacttctccatcctcttcgactatgagtatttgaatccgaacgaagaagagccgaatgcacataaggtcgccagcccaccctccggacccgcataccccgatgatgtaatggactatggcctcaagccatacagcccccttgctagtctctctggcgagccccccggccgattcggagagccggatagggtagggccgcagaagtttctgagcgcggccaagccagcaggggcctcgggcctgagccctcggatcgagatcactccgtcccacgaactgatccaggcagtggggcccctccgcatgagagacgcgggcctcctggtggagcagcctcccctggccggggtggccgccagcccgaggttcaccctgcccgtgcccggcttcgagggctaccgcgagccgctttgcttgagccccgctagcagcggctcctctgccagcttcatttctgacaccttctccccctacacctcgccctgcgtctcgcccaataacggcgggcccgacgacctgtgtccgcagtttcaaaacatccctgctcattattcccccagaacctcgccaataatgtcacctcgaaccagcctcgccgaggacagctgcctgggccgccactcgcccgtgccccgtccggcctcccgctcctcatcgcctggtgccaagcggaggcattcgtgcgccgaggccttggttgccctgccgcccggagcctcaccccagcgctcccggagcccctcgccgcagccctcatctcacgtggcaccccaggaccacggctccccggctgggtacccccctgtggctggctctgccgtgatcatggatgccctgaacagcctcgccacggactcgccttgtgggatcccccccaagatgtggaagaccagccctgacccctcgccggtgtctgccgccccatccaaggccggcctgcctcgccacatctacccggccgtggagttcctggggccctgcgagcagggcgagaggagaaactcggctccagaatccatcctgctggttccgcccacttggcccaagccgctggtgcctgccattcccatctgcagcatcccagtgactgcatccctccctccacttgagtggccgctgtccagtcagtcaggctcttacgagctgcggatcgaggtgcagcccaagccacatcaccgggcccactatgagacagaaggcagccgaggggctgtcaaagctccaactggaggccaccctgtggttcagctccatggctacatggaaaacaagcctctgggacttcagatcttcattgggacagctgatgagcggatccttaagccgcacgccttctaccaggtgcaccgaatcacggggaaaactgtcaccaccaccagctatgagaagatagtgggcaacaccaaagtcctggagatccccttggagcccaaaaacaacatgagggcaaccatcgactgtgcggggatcttgaagcttagaaacgccgacattgagctgcggaaaggcgagacggacattggaagaaagaacacgcgggtgagactggttttccgagttcacatcccagagtccagtggcagaatcgtctctttacagactgcatctaaccccatcgagtgctcccagcgatctgctcacgagctgcccatggttgaaagacaagacacagacagctgcctggtctatggcggccagcaaatgatcctcacggggcagaactttacatccgagtccaaagttgtgtttactgagaagaccacagatggacagcaaatttgggagatggaagccacggtggataaggacaagagccagcccaacatgctttttgttgagatccctgaatatcggaacaagcatatccgcacacctgtaaaagtgaacttctacgtcatcaatgggaagagaaaacgaagtcagcctcagcactttacctaccacccagtcccagccatcaagacggagcccacggatgaatatgaccccactctgatctgcagccccacccatggaggcctggggagccagccttactacccccagcacccgatggtggccgagtccccctcctgcctcgtggccaccatggctccctgccagcagttccgcacggggctctcatcccctgacgcccgctaccagcaacagaacccagcggccgtactctaccagcggagcaagagcctgagccccagcctgctgggctatcagcagccggccctcatggccgccccgctgtcccttgcggacgctcaccgctctgtgctggtgcacgccggctcccagggccagagctcagccctgctccacccctctccgaccaaccagcaggcctcgcctgtgatccactactcacccaccaaccagcagctgcgctgcggaagccaccaggagttccagcacatcatgtactgcgagaatttcgcaccaggcaccaccagacctggcccgcccccggtcagtcaaggtcagaggctgagcccgggttcctaccccacagtcattcagcagcagaatgccacgagccaaagagccgccaaaaacggacccccggtcagtgaccaaaaggaagtattacctgcgggggtgaccattaaacaggagcagaacttggaccagacctacttggatgatgttaatgaaattatcaggaaggagttttcaggacctcctgccagaaatcagacgtaagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgctgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagtttggtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtgggtgaccagattacaggtcagccttcgtctcagttacaacctattacatatggtccttcacattcagggtctgttacaacagcttccccagcagcttctcatcccttgggtagttcaccgctttctgggccaccatctcctcagtttcagcctatgccttaccaatctcctagctcaggaactggctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgaccaatttatatctgacttggaacaccagccatcaggttcagcagagaaatggcctaaccacagtgtgctctcatgtccagctcctttctggagaatctagaggtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactcttcaaccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttaaatgatgggtgctttgagtgtgaatccagcaggctctcttgtttccgaggtgctgcttttgcaggtgacctggttacttaactaggagtggtgatttgtactgctttatggtcatttgaagggccctttagtttttatgataatttttaaaataggaacttttgataagaccttctagaagcaagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgctgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagtttggtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtgggtgaccagattacaggtcagccttcgtctcagttacaacctattacatatggtccttcacattcagggtctgttacaacagcttccccagcagcttctcatcccttgggtagttcaccgctttctgggccaccatctcctcagtttcagcctatgccttaccaatctcctagctcaggaactggctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatgatttgtttaccagtaataattttgacttgcttcagttgagacctacgttttggccagtcccagcaggaagatatctgaggaatctagagtgaacgagataattgggagagacatgtcccagatttctgtttcccaaggagcaggggtgagcaggcaggctcccctcccgagtcctgagtccctggatttaggaagatctgatgggctctaacagtgcttactgcagccttgtgtccaccaccaacttctcagcatgtttctctccttggaccttgggtttccaactcttcaaccttcaggtctggggccaggagtgggacccaccatttgtggggaaagtagcattcctccacctcaggccttgggtagatttggcaaaagaacaggagcagcataggctgtttgagctttggggaaatgaactttgctttttatatttaactaggatacttttaaatgatgggtgctttgagtgtgaatccagcaggctctcttgtttccgaggtgctgcttttgcaggtgacctggttacttaactaggagtggtgatttgtactgctttatggtcatttgaagggccctttagtttttatgataatttttaaaataggaacttttgataagaccttctagaagcaagctgcagcaccctgggccacgccgatgactactgcaaactgtggcgcccacgacgagctcgacttcaaactcgtctttggcgaggacggggcgccggcgccgccgcccccgggctcgcggcctgcagatcttgagccagatgattgtgcatccatttacatctttaatgtagatccacctccatctactttaaccacaccactttgcttaccacatcatggattaccgtctcactcttctgttttgtcaccatcgtttcagctccaaagtcacaaaaactatgaaggaacttgtgagattcctgaatctaaatatagcccattaggtggtcccaaaccctttgagtgcccaagtattcaaattacatctatctctcctaactgtcatcaagaattagatgcacatgaagatgacctacagataaatgacccagaacgggaatttttggaaaggccttctagagatcatctctatcttcctcttgagccatcctaccgggagtcttctcttagtcctagtcctgccagcagcatctcttctaggagttggttctctgatgcatcttcttgtgaatcgctttcacatatttatgatgatgtggactcagagttgaatgaagctgcagcccgatttacccttggatcccctctgacttctcctggtggctctccagggggctgccctggagaagaaacttggcatcaacagtatggacttggacactcattatcacccaggcaatctccttgccactctcctagatccagtgtcactgatgagaattggctgagccccaggccagcctcaggaccctcatcaaggcccacatccccctgtgggaaacggaggcactccagtgctgaagtttgttatgctgggtccctttcaccccatcactcacctgttccttcacctggtcactcccccaggggaagtgtgacagaagatacgtggctcaatgcttctgtccatggtgggtcaggccttggccctgcagtttttccatttcagtactgtgtagagactgacatccctctcaaaacaaggaaaacttctgaagatcaagctgccatactaccaggaaaattagagctgtgttcagatgaccaagggagtttatcaccagcccgggagacttcaatagatgatggccttggatctcagtatcctttaaagaaagattcatgtggtgatcagtttctttcagttccttcaccctttacctggagcaaaccaaagcctggccacacccctatatttcgcacatcttcattacctccactagactggcctttaccagctcattttggacaatgtgaactgaaaatagaagtgcaacctaaaactcatcatcgagcccattatgaaactgaaggtagccgaggggcagtaaaagcatctactgggggacatcctgttgtgaagctcctgggctataacgaaaagccaataaatctacaaatgtttattgggacagcagatgatcgatatttacgacctcatgcattttaccaggtgcatcgaatcactgggaagacagtcgctactgcaagccaagagataataattgccagtacaaaagttctggaaattccacttcttcctgaaaataatatgtcagccagtattgattgtgcaggtattttgaaactccgcaattcagatatagaacttcgaaaaggagaaactgatattggcagaaagaatactagagtacgacttgtgtttcgtgtacacatcccacagcccagtggaaaagtcctttctctgcagatagcctctatacccgttgagtgctcccagcggtctgctcaagaacttcctcatattgagaagtacagtatcaacagttgttctgtaaatggaggtcatgaaatggttgtgactggatctaattttcttccagaatccaaaatcatttttcttgaaaaaggacaagatggacgacctcagtgggaggtagaagggaagataatcagggaaaaatgtcaaggggctcacattgtccttgaagttcctccatatcataacccagcagttacagctgcagtgcaggtgcacttttatctttgcaatggcaagaggaaaaaaagccagtctcaacgttttacttatacaccagttttgctgaagcaagaacacagagaagagattgatttgtcttcagttccatctttgcctgtgcctcatcctgctcagacccagaggccttcctctgattcagggtgttcacatgacagtgtactgtcaggacagagaagtttgatttgctccatcccacaaacatatgcatccatggtgacctcatcccatctgccacagttgcagtgtagagatgagagtgttagtaaagaacagcatatgattccttctccaattgtacaccagccttttcaagtcacaccaacacctcctgtggggtcttcctatcagcctatgcaaactaatgttgtgtacaatggaccaacttgtcttcctattaatgctgcctctagtcaagaatttgattcagtttggtttcagcaggatgcaactctttctggtttagtgaatcttggctgtcaaccactgtcatccataccatttcattcttcaaattcaggctcaacaggacatctcttagcccatacacctcattctgtgcataccctgcctcatctgcaatcaatgggatatcattgttcaaatacaggacaaagatctctttcttctccagtgggtgaccagattacaggtcagccttcgtctcagttacaacctattacatatggtccttcacattcagggtctgttacaacagcttccccagcagcttctcatcccttgggtagttcaccgctttctgggccaccatctcctcagtttcagcctatgccttaccaatctcctagctcaggaactggctcatcaccgtctccagccaccagaatgcattctggacagcactcaactcaagcacaaagtacgggccaggggggtctttctgcaccttcatccttaatatgtcacagtttgtgtgatccagcgtcatttccacctgatggggcaactgtgagcattaaacctgaaccagaagatcgagagcctaactttgcaaccattggtctgcaggacatcactttagatgatggtaagttcatctctgatatgttcttgaagtagtgaagattcagggactttattctcccaagtgtcatgaaaaagtttctatggattgcttattggcatatggttgggcttttaaataagttgttattagaaatatatgttaatatataactttgccaggtaccacggctcacgcctgtatcccagcactttggaaggctgaggcgggtggatcacaaggtcaggagttcaagaccagcctggccaacatggtgtaacgctgtctctactaaaaatacaaaaaattagccaggcatggtggtgtgtgactataatcccagctactcgggaggctgagacaggagaatcacttgaacccgggaggtggcagttgcagggagctaagatcgcgccattgcactccagcctgggcggcagagcaagactccgtctcgggaaaaaaaaaaaaaaaaaagaattccgggccgggagaaccgaacccctggcggccgcgaccccggctcccgccccggccccggcccgacccgccatgacggggctggaggaccaggagttcgacttcgagttcctcttcgagtttaaccagcgcgacgagggcgccgccgcggccgccccagaacactatggctatgcatcctccaacgtcagccccgccctgccgctccccacggcgcactccaccctgccggccccgtgccacaaccttcagacctccacaccgggcatcatcccgccggcggatcacccctcggggtacggagcagctttggacggtgggcctgcgggctacttcctctcctccggccacaccaggcctgatggggcccctgccctggagagtcctcgcatcgagataacctcgtgcttgggcctgtaccacaacaataaccagtttttccacgatgtggaggtggaagacgtcctccctagctccaaacggtccccctccacggccacgctgagtctgcccagcctggaggcctacagagacccctcgtgcctgagcccggccagcagcctgtcctcccggagctgcaactcagaggcctcctcctacgagtccaactactcgtacccgtacgcgtccccccagacgtcgccatggcagtctccctgcgtgtctcccaagaccacggaccccgaggagggctttccccgcgggctgggggcctgcacactgctgagttccccgcggcactccccctccacctcgccccgcgccagcgtcactgaggagagctggctgggtgcccgctcctccagacccgcgtccccttgcaacaagaggaagtacagcctcaacggccggcagccgccctactcaccccaccactcgcccacgccatccccgcacggctccccgcgggtcagcgtgaccgacgactcgtggttgggcaacaccacccagtacaccagctcggccatcgtggccgccatcaacgcgctgaccaccgacagcagcctggacctgggagatggcgtccctgtcaagtcccgcaagaccaccctggagcagccgccctcagtggcgctcaaggtggagcccgtcggggaggacctgggcagccccccgcccccggccgacttcgcgcccgaagactactcctctttccagcacatcaggaagggcggcttctgcgaccagtacctggcggtgccgcagcacccctaccagtgggcgaagcccaagcccctgtcccctacgtcctacatgagcccgaccctgcccgccctggactggcagctgccgtcccactcaggcccgtatgagcttcggattgaggtgcagcccaagtcccaccaccgagcccactacgagacggagggcagccggggggccgtgaaggcgtcggccggaggacaccccatcgtgcagctgcatggctacttggagaatgagccgctgatgctgcagcttttcattgggacggcggacgaccgcctgctgcgcccgcacgccttctaccaggtgcaccgcatcacagggaagaccgtgtccaccaccagccacgaggccatcctctccaacaccaaagtcctggagatcccactcctgccggagaacagcatgcgagccgtcattgactgtgccggaatcctgaaactcagaaactccgacattgaacttcggaaaggagagacggacatcgggaggaagaacacacgggtacggctggtgttccgcgttcacgtcccgcaacccagcggccgcacgctgtccctgcaggtggcctccaaccccatcgaatgctcccagcgctcagctcaggagctgcctctggtggagaagcagagcacggacagctatccggtcgtgggcgggaagaagatggtcctgtctggccacaacttcctgcaggactccaaggtcattttcgtggagaaagccccagatggccaccatgtctgggagatggaagcgaaaactgaccgggacctgtgcaagccgaattctctggtggttgagatcccgccgtttcggaatcagaggataaccagccccgttcacgtcagtttctacgtctgcaacgggaagagaaagcgaagccagtaccagcgtttcacctaccttcccgccaacgttccaattataaaaacagaacccactgatgattatgagcctgctccaacctgtggaccggtgagccaggggttaagtcctctcccaagaccatactacagccagcagctcgcgatgccacccgaccccagctcctgcctcgtggccggcttcccgccctgtccgcagagaagcaccctgatgccagcggcccctggcgtgagccccaagctccacgacctttctcccgctgcctacaccaagggcgttgccagcccgggccactgtcacctcggactcccgcagccggccggagaggcccccgccgtccaggacgtgcccaggccagtggccacgcaccccggctcgcccgggcagccacccccggccctgctgccacagcagtaaatgaaataatacgaaatgacctctccagcacgagcacccactcctagttgccacattggagcactcagttcagcaggggtatgctgacttcagcagacaaagacttttgaataaataaactgaactcacacctggtaccactcagaacctccaactgactgaatgccaggagctgaacattaatatgtgcaaagattggctctccaacaagaaggaaagcagggaggaagggagaccactgtgtcgcctggaggagaagtcatctcatgacaacagaagggaggtggccgggctgagcacggagacccaccgtgcaggggcctttcatgggaacggcccacacgcagtttgaccccacgcccagcccttctggcacccctggggttcaatactggaagtgccttatttaaccagaccatca

SEQ ID NO: 2753 - DNA, 261 bp; single-stranded, linear
gaattcccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagggaattc

SEQ ID NO: 2754 - DNA, 1910 bp; single-stranded, linear
gtccttcgcgtcccggcggcgcggcggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgcacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggctgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcccccccgaccgcctgctacgcgggggccgggccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcggcgtccccctggggccggccggggctgagactccggggagcgcccgcgcccgcgccctcgcccccncccccnnnnccgcaaaactttggcactggggcacttggcagcnggggagcccgtcggtaattttaatattttattatatatatatatctatattttgccaaccaaccgtacatgcagatggctcccgcccgtggtgtataaagaagaaatgtctatgtgtacagatgaatgataaactctctgctctccctctgcccctctccaggcccggcgggcggggccggtttcgaagttgatgcaatcggtttaaacatggctgaacgcgtgtgtacacgggactgacgcaacccacgtgtaactgtcagccgggccctgagtaatcgcttaaagatgttctagggcttgttgctgttgatgttttgttttgttttgttttttggtctttttttgtattataaaaaataatctatttctatgagaaaagaggcgtctgtatattttgggaatcttttccgtttcaagcaattaagaacacttttaataaacttttttttg

SEQ ID NO: 2755 - DNA, 2171 bp; single-stranded, linear
gaattcccaaggcgcccccgaccgcctgctacgcgggggccgcgccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagggaattcgtccttcgcgtcccggcggcgcggcggaggggccggcgtgacgcagcggttgctacgggccgcccttataaataaccgggctcaggagaaactttagcgagtcagagccgcgcacgggactgggaaggggacccacccgagggtccagccaccagccccctcactaatagcggccaccccggcagcggcggcagcagcagcagcgacgcagcggcgacagctcagagcagggaggccgcgcacctgcgggccggccggagcgggcagccccaggccccctccccgggcacccgcgttcatgcaacgcctggtggcctgggacccagcatgtctccccctgccgccgccgccgcctgcctttaaatccatggaagtggccaacttctactacgaggcggactgcttggctgctgcgtacggcggcaaggcggcccccgcggcgccccccgcggccagacccgggccgcgcccccccgccggcgagctgggcagcatcggcgaccacgagcgcgccatcgacttcagcccgtacctggagccgctgggcgcgccgcaggccccggcgcccgccacggccacggacaccttcgaggcggctccgcccgcgcccgcccccgcgcccgcctcctccgggcagcaccacgacttcctctccgacctcttctccgacgactacgggggcaagaactgcaagaagccggccgagtacggctacgtgagcctggggcgcctgggggctgccaagggcgcgctgcaccccggctgcttcgcgcccctgcacccaccgcccccgccgccgccgccgcccgccgagctcaaggcggagccgggcttcgagcccgcggactgcaagcggaaggaggaggccggggcgccgggcggcggcgcaggcatggcggcgggcttcccgtacgcgctgcgcgcttacctcggctaccaggcggtgccgagcggcagcagcgggagcctctccacgtcctcctcgtccagcccgcccggcacgccgagccccgctgacgccaaggcccccccgaccgcctgctacgcgggggccgggccggcgccctcgcaggtcaagagcaaggccaagaagaccgtggacaagcacagcgacgagtacaagatccggcgcgagcgcaacaacatcgccgtgcgcaagagccgcgacaaggccaagatgcgcaacctggagacgcagcacaaggtcctggagctcacggccgagaacgagcggctgcagaagaaggtggagcagctgtcgcgcgagctcagcaccctgcggaacttgttcaagcagctgcccgagcccctgctcgcctcctccggccactgctagcgcggcccccgcggcgtccccctggggccggccggggctgagactccggggagcgcccgcgcccgcgccctcgcccccncccccnnnnccgcaaaactttggcactggggcacttggcagcnggggagcccgtcggtaattttaatattttattatatatatatatctatattttgccaaccaaccgtacatgcagatggctcccgcccgtggtgtataaagaagaaatgtctatgtgtacagatgaatgataaactctctgctctccctctgcccctctccaggcccggcgggcggggccggtttcgaagttgatgcaatcggtttaaacatggctgaacgcgtgtgtacacgggactgacgcaacccacgtgtaactgtcagccgggccctgagtaatcgcttaaagatgttctagggcttgttgctgttgatgttttgttttgttttgttttttggtctttttttgtattataaaaaataatctatttctatgagaaaagaggcgtctgtatattttgggaatcttttccgtttcaagcaattaagaacacttttaataaacttttttttg

SEQ ID NO: 2756 - DNA, 2426 bp; single-stranded, linear
gaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccacgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctaacaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcggaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagatgatccctgtatttcaagacctctgtcc

SEQ ID NO: 2757 - DNA, 2557 bp; single-stranded, linear
gaattccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagctgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagagggg

SEQ ID NO: 2758 - DNA, 1560 bp; single-stranded, linear
cccgggttcaagcgattctcctgcctcagcctcttgggtagctgggattataggcgtgtgccaccgtgcctggctaatttttgtatttttattggagacagggtttcaccatgttggccaggctggtctgaaactcctgacctcaggcaatcctcctacctcagcctctcaaagtgctgggattaccggcatgagccacgactcccggccccaaaggtcaatcttaaagctacaaggtatcttttaaaaggagtaggaataacgtattttgaggcttaaaggagtaggaatagtgtatttttagatttgaagccatcttctaaagggtacgatatttggttaacatgtcactccttatcgccatggaagaagttaattctattcttttttttttttttttgagatggagtctcactctgttgcccaggctggagtacaatggtgtgatctcagctcactgcaacctctgcctcctgggttcaagcaattctcctgcctcagcctcctgagtagcagggattacaggggttctccaccatgcctgtctaatttttgtatttttttttttagtagaggtggagtttcaccatgttggtcaggctggtctcaaacccctaacctcatgatccgcccgccttggcctcccaaagtgctgggattacaggcgtgagccaccatgcccagccgttaattctattcttactgcttactcccttattttgtatgttcttcttctatcttacatcttttgcttttgctattgcttaagctagcctacgccaagggtgctctttgccccctacttcctctgctattctcgcctcagttccgctgcattccaagctcagcctgccccagcagcaggtctctttgacaaacctgcaattttggggaaaagtcagccccaagaaaggcagggggcccagacttatgctgtgtggcaaaagccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgtgagtgtttactctgtttccacatcactttaactccatgagcatcgaag

SEQ ID NO: 2759 - DNA, 2557 bp; single-stranded, linear; identical to SEQ ID NO: 2757

SEQ ID NO: 2760 - DNA, 1438 bp; single-stranded, linear
tcttttggttttgctattgcttaagctagcctacgccaagggtgctctttgccccctacttcctctgctattctcgcctcagttccgctgcattccaagctcagcctgccccagcagcaggtctctttgacaaacctgcaattttggggaaaagtcagcccaagaaaggcagggggcccagacttatgctgtgtggcaaaagccctctttgatggggcaagggtaggactggaaaagcagagagatctttctggatgtcctgggagagcagccctttgggtggtgggtggaggctggaggcagggaggaatcccctcacagtgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgtgagtgtttactctgtttccacatcactttaactccatgagcatcgaagcttctggaatcaacatgtttcttatgtttcttgcaggttcaagccttgagggtcaagaaaactgtaagtctgatgtttccactgtaacagatgtttctacctggcttcctcctttctcttctgtgatgcctaaaacgcacattaaattgctggggtttgatacttctaacaattaaggaaaagaatccaattgagaactaaagtttatcccatgtgggcatttttagaaaggcttagatctaagccaagttctggtcagtgtgttttagaagtagcacacgtttccttggctggtctgaaagtagtgggttatcttgatgaattgtttagtcagttacagatcaaactccatgttcttttctctgttctcacgactactcttgactagtctaaaaatatattaggttgttgaaaagtaattgtggtttttgccattactttttaaaagatggcaaaaaacacaattataagtagcacacattttcttttttttttccttttttttttgagacagagtctctgttacccaggctggagtgcagtggtgcaatccggctctctgcaaactccgcctccagggttcaagggattctcctgtctcagcctcctgggtcgctggaattagagg

SEQ ID NO: 2761 - DNA, 350 bp; single-stranded, linear
ttggcaggctggtctcaaactcctgacctcaggtgatccgctggcctccacctcccaaagtgctgggattacaggtgtgagccaccacgcccggcctcacattttctagatttcagtgcattgctgttttttgggatggggaagtgatttttttattttaatgagcaattccataattagttttttgttgttttaccataatggcttatttgaatattgtaaggtatccccaactgtttttatttgcaaatgagatataattgatttgttagacatatgaagacagatcctagtttaaattgttgctactttttttactcctaaatgataaaaatcacacactcgagctc

SEQ ID NO: 2762 - DNA, 350 bp; single-stranded, linear; identical to SEQ ID NO: 2761

SEQ ID NO: 2763 - DNA, 265 bp; single-stranded, linear
gctgtcccacagcccacccttcatcacaatagtcctgaaactttttgggttcagtaaggaaatctgtgggccttctctccagaaaaagcacacatttgcacacaattggaggtagttgatgagcctcctaacacccacccatgcacctcccaggggctgtgtcccccaggttgtgaacagtcactctgtgtaaatagtgagacctacaggcagtaattcagtttggctgtgcttggctggtttatttagaaagatgataatgttt

SEQ ID NO: 2764 - DNA, 168 bp; single-stranded, linear
gagctctccaagggcagacactgccagcctcactgttctctgaacccccagtatgggacagtgcttggcacagaaaaacccccttaaatgtttgctatgaatggtgctaaggaagaaggcagagaatgtcaaccagaggccaggcactggcaatatatacacggcccc

SEQ ID NO: 2765 - DNA, 243 bp; single-stranded, linear
ataccttggctcactgcaacctctgcctcccaggttcaagcagttctcctgcctcagtctcccaagtagctgggattacaggcgcccaccaccacacccggctaattttgtatttttagtagagatgaggtttcaccatgttggccaggctggtcttgaactcctgacctcaagtgatccacccgcctcggcctcccaaagtgctgggattacaggcataaaccaccgtgcccggctggtcca

SEQ ID NO: 2766 - DNA, 272 bp; single-stranded, linear
gagctcatccagcaggcttcttaaatcaggagcttgtaagttgcatataaagacaaaaaagggagttccaaagagtaatgctgtgggaaatgacttgaatttaaaccgtcaccttgtttgatctcatggactggtcagacaccatttttgttgtcgttgttgttgttaaattaattgctcagaatatagcagcaggcgcaaattgtagtactcgttttaaaattgaagattaaattttaaattacccaacaaaggcctaactttgttaaaag

SEQ ID NO: 2767 - DNA, 4308 bp; single-stranded, linear
gaattctaccgacagcctatggttactggatataagccaattctgttctggggacttgccagaaatgacacaattggccagttgacccacagcctagttcctagcagagattggatagctgattgagcgttgtggctgttttgaggcttgaccagagattcctgccgttggcagaggggaatctgtagtctttgcttcttggtagcaggtgaggctgaaaacgcaagtagcaggctaaaaactggtttcaagtcctcaccatctggtgaaacctcagagcccatcagatagaaaatgccagctgggactgtgctaattcggtaaggcctgggtggagaaggagggcctgggcacgaccatctggtttcggaatggaggtagcagtcatttattaagtacttaatgtatatcgggcactgtacaggagacgttctggctgttctcctgtacatttcctgcaaagacctaatgagatatgattactccatcctacaggtaaggaaactgagctcagagagtctagctgcccagggtcacacagtaaatgatgagccaggacttgaacacttgactgcttgaatcctgtactccctccaggggccaagatgtggcagctcacagaatgcctatatctttttttttttttgtcttttgagacagtctcactctgttgcccaggctggagtgcagtggtgagatctcacctcactgcaacccccgcctcccaggttcaagtgattcttgtgcctcagcctctcaagtagctgggttacaggcctgcaccaccaaacctggctaatttttgtatttttagtagagagggggtttcaccatgttggccaggccagtctctaactgctgacctcaggtgatccacccaccttggtctcccaaagtgctgggattataggcgtgagccaccatacctagctctacatctttatcactctgttcctttgccttggtgggaaaagttgcagcttagtaccaactgcctcctgcttgagccactgtgcacagttactatcagcctggccctgtaggcacgtagaacccctggactcaatactgcataggatgggataagaccacatctgatgtggtgaaggtcaccgggatgatgttgtttctgagataacaggtatgtctgccttccttcgggttgcatttagctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagctgttggtggaaggtgagtccttggaactgagcacaggcaagcagatggagcatagcacacagtggcgtgaataacagctgtgaatgaatagtgacactggacttaactctccacccatcaccctctcattcatctgcctggcattttccttacctgaatacgtaagcactagacatattccccaataggcaggcccttccttccttccttccttccttccttccttccttccttccttccttccttccttccttccttcctttctttctttgatggagtctcactctgtcacccagtctggagtgcagtgggtgatctcggctcactgcaacctctgcctcccaggttcaagcgattctcctgcctcagcctcccaagtaattgggattacaggtgtgtgccaccacacctggctaattttgtatttttagtagagatggggtttcactgtgttggtcaggctggtctcgaactctgacctcaagtgatccacctgcctcccaaaatgcttcttcatctcgctctataaattacaatttctttcttcaagactcaactcaatgatgttttgccaaaacaaaatgggtctaccccagggtgccagtcagtacagctctgatgctctctctacaggcaatggtatttgtgtgtataaaggccacagcggtgtgttaagacacctcgttctgcagtcactctgcctgggtttcaatcttgggtcaagtccttaacatgctctaaacttcaaaatcctcaccagtaaaaggaagataacaacgatacccatttcaggcaattattgagagggttaaaagtgtcatgtgggtagagtgcttagcaaaatttccagcacctagtgagttcctaataaatagaaatgtatttatttatttgagacagagtcttcctctgtcacccaggctaaagagcaatggcgcgaccttggctcactgcaacctctgtctcctgggttcaagcgattctcctgtctcagcctcccaagaaactgggattacaggcacgcgccactgtgcctggctaattttttgtatttttagtaaggatggggttttaccatgttggccagcctggtctcgaactcctaacttcaagtgatttacccaccttggcctcccagagtgtcaggattacaggtgtgagccaccatgcccggtccacaaatattctatttcactcagtattggcatccgttcttacacatctgtctgctcttctggatagtgaaattgtaaagacagagatggtgtttgggtttattcttatatcttgaacaatgaatctggctcatagtaggcattcagtcaatgttcatggaataaattaaagtcagtcctagcctgtgggtgcattcaataaagggtaacaacaatcacagtgacactgacaaatactgggttacctttcccctctaagcatcatctgttgggaatctgattgtgtcctcttcccaataggattataaaccattgaaaacaccaagtacatcttgaccatattttattttttaaatttatttatttatttatttatttatttttagacagagtctcactctgttgcccaggctggagggcagtggcacgatctcagctcactgcaacctctgccttcggggttcaagcaattctcctgcctcagcctccaagtagctgggattacaggtgcctgccaccatgccggctaattttgatttaatagagatggggttcgccatgttggccaggctggtctcaaactcctgacctcaggtgatccacctgcctcagcctcccaaagtgttgagattacagatgtgagccacctcgcgtggccttagtggtgattttggtggacccatcacccgagcagtgtacactgtacccagtgtgtagtcattttatccctcgctccctcccactctttcccctgagtccccaaagtccactgtatcattcttatgcctttgtttcctcatagcttagctcccattgagcatattttatattttttcctttcttttcttctcttttttgagacagggtctctgttgcccaggctggagtgcagtggtgggattactgctcactgccgcctcaacctcctaggctcaagtgattctcccacctcggcctcccaagtagctgggactaccagtgcacaccactaactacccctggctaattttaatttttttttttgtagagatagcatttcaccgtgttgcccaggctggtctccaactcctgggctcaagagatccacccacctcagcctccagattttatatatttcaaagtgcctagtactgtgctgggcacatacctgttcatttattacctggtaggtcgcactgggtgttcagagaacaaaaaagagccctctcatgggatcaactacagtcactcagcggaggggagggcttgtgtctctcaatcaggctgatactgacagactttcttcttcaatcaggctgatactgacatgactttctactttccccgtaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacgggtcagcatctgctcccttcctcatcgttctttgtggtttctggt

SEQ ID NO: 2768 - DNA, 867 bp; single-stranded, linear
gttctagagaagaaaggttgaattttaaagttagttaggaacaatagaaaagtttgaaaaggggaagcagcaaaaagagcagaagaggctcctcttgcccaggtttgcacctgagtccaaccaggttgtcttcctctcttgcagaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacaggtagggctgctgctgccggagggtgttggcatatggcgggctcaagaggccaccatgctgcaatccagcatggccaaagagagctgatcatttcctgcccctgcttatctgaatgaatgtgctcagatggggctttggtgctcgtgggaggaaaccactgcagagcgagttaacagtctactgtgcgtgttgagggtacaggctccggcaccaaagcttaaccctgccgctcactgcttctgtgaccttgggtgagttattgaacgtgccgcagcgctgtgagatggtgataatgaccttttaggactgctataatgattaatgagataactatactgtaagcatgagctgagagatttgtacagagtaagactctgaaacactggttaatgttttcattactctgttatatttctccatcccctgtgacaagcactatgctagatc

SEQ ID NO: 2769 - DNA, 1872 bp; single-stranded, linear
gaattccggcctgtgaatccatctggttcttggactttttttggttggtaagctattgattattgccacaatttcagatcccgttattggtctattcagagattcaacttcttcctggtttagtcttgggagagtgtgtgtgttgaggaatttatccatttctcctagattttctagtttatttgcgtagaggtgtttgtagatattctctgatggtagtttgtatttgtgtgggatcggtgatgatatcccctttatcattttttattgcgtgtatttgattcttctctctttttttctttattaggcttgctagcggtctatcaattttgttgatcctttcaaaaaaccagctcctggattcattaattttttgaagggttttttgtgtctctatttccttcagttctgctctgattttagttatttcttgccttctgctagcttaaggagtttcattcttgttgcccaggctggagtgcagtggagcaatctcggctcactgcaatctctgtctcctgggttcaagggattctcttgcctcagcctcccgagtatctgggattacaggcgcccaccaccatgctggctaattttatatttttagtagagatggggtttcaccatgttgcccaggctggtctcaactcctgacctcaggtgatccacccacctctgcctcccaaagtgctgggattacaggcatgagccaccacacctggccacaagttgcaaaacttttctaatccttgtcattgaaataaattggattaacaagaaaggaaaacctgccattggaatcctaggcaaagaatgaaccctagctccttactggggtgatcgttaggtacatgagaagcaaaggaaaactttttgctggaagttggaagttggttctgccaagagcacctgagccaagggcctctccaggaagggtctttagggtggtggccagacacatctcgctccattcccactcactgtttttcagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtggtgagtatattgttgcgactcagaggacatccggggttgaatgggagaaaggaaatttatctgcagctgccgccctctccggtctccggtctgagcagactcaggcagggtaagaactagagggagagaagtgcgaaatcaaaggccaaagaaacaaggaggtattcctgctcagaacactgattcactgatgatgatgtggcctctgacttgcaagattctggcaagattctgcctcctggagcaagacccacccaaaagttcaggaaggaaacactacttagtcaatgttaaacttttcttttttttttttgagacgtgtcgcccaggctagagtgcagtggcacgatagctcactgcaacctctgcctcctaggttcaagtgatctcctgcctcagcctcccaagtagctgggattacaggtgcccaccaccacgtctgcctaatttttgtatttttatttttattacttttatttatttatttatttattttttttcggtctgtcacccaggctggcagtgccagtggcacaatctgggcatcactggaaagcatccgcactcctgggtacacgagcattctcctgcctcagccctcccaagtgggtgtggactacaggacacaccgt

SEQ ID NO: 2770 - DNA, 5996 bp; single-stranded, linear
tcacttgagtccaggagttcaagaccagcctgagcacatagtgagaccctgtctctacaaaaaataaagaattagccaggtgtggtgtgcacctatagtcccagctactcgggaggctgaggtaggaggattgcttgattctgggaggttgtagtgagctgtcatcgcaccagtgcactccagcctgggtaatagagtgagaccctgtctcaaatacacacacacacacacacacacacacattttgttggctacttgttgtactttttctatgttttctgtgtctttgctcaacacaagaaaagtatattatgtgtgcatgtgcgtgtgagatatggtaaaatatgaacatgtatttctggggatgtaatgttttccttgaatttctgtcattctctgttttgcttattgtacttctctttccctttcccttctcaccacacacacacacacacacacacacacacacacacagcctgtcagtctcataggtgtcctataaaggtaaatggcaggcaggcatttgaaattacagcagggatagaaagcaaaactcaggctttggaggaggaacctcttgtgctggatgctttgtttttaccttcagtgccttttggattgtttctccctctgttctagaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccacgccaaaatgttaagtgaggttctgagggtgaaggtgataggtaagttgctgtgctgtgagaagaaatcatgtgggcttggggcattctttcacccccagggactgtggggacaataagagaagtagggggccaggtgcggtggctcatgcctgtaatcccagcactttaggaggccaaggccggtgaatcattgaggccaggagttcaagaccagcctggccaacatggtgaaaccccatctctactaaaaatacaaaaattagctgggcatgatggcgtgcgcctataatcccagccactcgggaggctgaggcaggagaattgcttgaacccaggaagcacaggttgcactgagccaagttgcgccattgcactccagcctgagcaacaagagcgaaactccatctaaaaaaaaaaaagcgagagaagtagtgggtgcttatgcaaagtccatatactagatatgcaccaaagcagggccaaggttcagtaaaggaggctggaaaatatttgggggctattgatgaggacaatataatctctttccagaacctttcaacaaactgctaaaagatgataagcatgaaagtgtcctgactgcaggaagcactgaagttgtgcatatgggcttcccttagcactttctccttttcagatacactgttctgagaattgtagatcaggactctgctgttgtgactcctagccggggaaccctgccttgtgtgaattcgagattagcctggccaacatggtgaaatcctgtctctaataaaaatacaaaaaattagctgggtgtggtggtgggcacctttaatgccagctactcgggaggctgaggcacaagaatcatttgaacctgggaggcagaggctgcagtgagccaatatcattccgctacactccagcctgggcaacggagcaagactccatctcaaaaaaaaaaaaaattaacattacatagactaagcacctaatggtgtgaggcatacaaaaaagaagacatattctttgtttcaatgctgtggtaagaaacacaagctctcctaatgaaaatgatggacaaacatctgaatcatactaccaataagcatagaaaaaatgttgggggtcatgtttggttgtcacgtgaactatatccttacagtgatggtgatagtaatttagggtatgccagacttcatctagcttaagtgggtaaacattgtgaaaaagctgggctaggtgccagggcttgagaatgggtggccagagaaggctgaagatggctgaacatctccagcaaacacatgagccaaaaggtcccatggggcacttcaaaagactgtgcgcagccaggtgcggtggctcacgcctataatcccagcactttgggagaccgaatggggtggatcacttgagcccagaggtttgtgactagcttggccaacatggcaaaaccccgtctctactaaaaatacaaaaattagcccagcgtggtggtgggtgtcctgtagccccagctactcaggtggctgaggtggtagaatcacttgaatccaggaggcagaggttgcagtgagccaagatcgtgccactgcactccagcctgggtgacagagtgagactctatctccacaaaaaaaaaaaaaaaaaaaaaaattaaaggactgtggccaaatcagatggctggaaacaaaggctggagtttgggaatggagaatcaccggatatgagctgaaaaagtggctgagcctaagcgtgacaggtgtcaggtgccagtctcaggagtaggcaattgtcctgcatgcagtgaaaagccagaagatggaaggaaggacaggatgcaaatgagttctcggaacgatccacctggtggctgggtcagggagcaggcatggtgacttcagacctcatggtacgttagaggctaatgtgaagcccatgtgaagctgttggtttaaactgggtcgatatcagtggcacacatttactgaccatgtgtccagccctgtgtgaagtactgtagtaaattgctccaatggaaactcacaataaccacagaaggccagtaacagcattgtcgttattttatcatgacgcaactgaggcttagggcagacagctggtgggtggtgggactgggatttgagcccactggtgtcccaggcccggagcttggcttcttccattgtcttaccacagcctgcactcacaggagagtgactcataagttacaataccatctgctgaccatctgctctcacactagaaggaaagtctacttggggagacaatttaggatccgaattttggtagttgaggatggagctaggaaaagcggatacaggaggtagccaagttctgcttggacctgcagggagtgaggctggccgggctccaggtggaaatccccaggtgaaaagggagacttggagttcaggaaagtaacctggactggagccataggtttaggtgtcagtggctcagagacagaagctcagcgtgtaggtgaaatcacccaggaggagaatggggatggaaaactgaggattgaattttgcaaaatgttcatacttccggggaaaacaaagaataaccagtgaataagaaaggggtgccaggtaagaagggaagagaatcagagtcatgaggaaccccagaaccccagaaaaagctgagttccacgtaagacctgggcaacagtgaagtatggagagcccaagattgggagcgtggaggaagagcatccaccactgaatttaatcagccccggactcagggacgttggttggggaatcaagtgaccttcccagtttcttcaaaacttgagagagagtgcagtgtcacaagattgtgactacaaaagagtgcagtcagatttcaggggtaacaagaaagtgtgaaataagggagtcaaagcataaaggaaaaaggagaaaaaatggccgatagctagagaaggcgtgggtcaagattgtctgtggcctggcatggtggcttatgcctgtaatcccagcattttggaaggccgaggtgggcaaatcacctgaggtcaggaattcaagaccagcctggccaacagggcaaaaccccgtctctaaaacaacaacaacaacaaaaaaatccaaaaagttagctgggcctggtgggcgcacctgtcattccagctactcgggaggctgaggcaggagatttgcttgaacccaggaggcacacgttgcggtaagctgagattataccactgcactccagcctgggtgataagagcgggactctgtctcagaggaaaaaaaaaaaagttgagcagtggctgtctcatgttcctcttcctctgcccttctttgctcagtgtgaatccttttcctgcttttcagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctaacaaggaacaggagggagagtattactgcacagccttcaacagagccaaccacgcctccagtgtccccagaagcaaaatactgacagtcagaggtgagtcagggtctccatagcaagctgtgctgtgggcccccaagggcaagaccagaaaacaccccccttgtaagagggagtttggggggagtctagcttatgtgactgaaggctaggagagtaatgtcctccaggctcttggttgcaagtgacagaaacccactcaaattaagtaaaaaagagaaatcgattattataaggaattgggagaatgtcacatcgttccaattacaaattgttggcagactcaccattgagtcatcttgggtcaaacatccaaccacagaccacctgtagccaaggggattgggtcacgcagaacagacatgattggggaaccacttatgtgggtgtgggggcggtttcctggagaagaagagggctgaaaacacatgccaaaaaggagtctactccacttgagccctggagttggagaccagcctgggcaacatggtgaaaccctgtctctacaaaaagtacaaaaataggctgggcgcagtggctcatacctgtaatcccagctactcgggaggctgagacatgagaatcacttgaacccaggaggtagaggttgcagtgagcagagcttgctccactgcactccagcctgggcaacagagcaagactctgcctcaaaaatcaaaccaacaaaaaatagctgtgtgtggtggtgtgctcctgtagtcccagctactcgggaggctgaggtggaaggattgctcaagcccaggaagttgaggctgcagtgagctgtcatcagcctctagcctgggtgacagagtgagaccctgttcaaaaagaaagaaaaagaaaagagtctacccagcaaagctggtttgttccctccttgaggaccacagctgacctctatttgtagcagaaacaatcatttctgcaccagctctgagtgcagaacccctcagaggtagatggatgctaaggcaagctgccagttacaagagctgtgagaatcagactgacttttgttgcttaaggcctgatattatttcttcctggcagaggaagagcctatatacaaaaaaaattttttgttttgttttgttttcagtcattcttgccccatggaagaaaggacttattgcagtggttatcatcggagtgatcattgctctcttgatcattgcggccaaatgttattttctgaggaaagccaagggtgagcatagttctttccttccatactgactggtcgtccttgccaggaaaccagccagggatgcgtggtgcttttctgacccctggattcagctaggcaaaaatgaaagctattattttcctcattgggcaaaccagaaaagataaaatttgggggaaattacatctttgtgtggttagaagaagccatttctgtagatttgtccacacctagtcctgtaatgcgtgtagagtggggtgcaagcgtcttggagacacacaaacatgcgcataacacccacatgttgcacacacacattg

SEQ ID NO: 2771 - DNA, 818 bp; single-stranded, linear
acctctttcttttctgtcttttgaaaaagagtgaatatatttgccttctttttctctctttttctgggtattcaatcttctgggaagtccaaacgtagctgaaaagagtgttccttcacagcttactaggagtaaaacaaaaagaaaagaaaagtgttttctatctattaggttagtgcaaaagccattggcgttttggccattatagtggtatggatgtgggtactgtatactgactttggtttttcgttttctgtttttaaagccaagcagatgccagtggaaatgtccaggtgagtgtatttgtaagaagggggcggctgctctgtgagcacggtggacatgtctggagggagattctggtcattaggaagttttcagtggctcttggcaaacttagaaaaatataggccttccttgggtgtgagttgtgtgtgtgagttgtgtgtgtgtgtgtgtgtgtgtgtgtgtgtgtatctccgtggaagaatgccaattgtcctttcatgggaaggaatggcttttattctgagatcatgtccttcctacatgattatttgtgaaatctccctttctttatgaaattataatggtagtagataattttttaaaatttgacaaaatagagttggcctttaaaaaatggttttactacctttactgttgttgaaatcccaaatcaaaagtatagaaatgattgctctgttccagagagaaacagtagcgtgggataagaatttcagggggcttggtagtagcctgtgaaggactccggtattcatgtgtgctttggtctgatgttatttaataggaaagtt

SEQ ID NO: 2772 - DNA, 946 bp; single-stranded, linear
aaaaaaaaaaaaagtttttttacataatccttggagctgccaaaaaatatttgttttccaaatgagagagtaaagttttccttaccttggaaaactcttcctggttttctcatgatcttcccttgtttactttggtggtttggggttagaacaataacaacaacaaatatatctatatattgttttctgtttttatatttcattttaaaggccagcagtaccacttctgaactccaacaacgagaaaatgtcagatcccaatatggaagctaacagtcattacggtaaagtcatgttctcctgccatttataattccccccaacttgctacatacttccttacccctctcagaagcagaatatgtaagtggtgggattacagttggaagagaaaccctggcttcaacagggtacttcatctcatcagccactgggccatgtaatatacggaaacgtaaaaggaaaggtaacatattttattctaactttgccaccttccaaactccccgtagaagaaagatggagaataatcataatgccttcaaagactttgaacattgctccagcgtaatattataattctccattttcaagacagagacagatattgaatgaaacattggtaaacatcttctcagatggaattattacaagcacaagacagttttacttcaaatttggcacaaagggaaagcaatttcaatattctctcagtaaaggcataaataaagtgttccaactaagaaaatatctattcataaggctcatcagtagcttcagggtcagctcagctgaatgagtaggcagtcctaggagttcttaatcccaggttagtaagaaaattgctcaagcatttcagcaggatgctacttacttcccagaggggggtattattacatcacaaaaagtcctgtcccagaccaaatttggggacactcttcctctt

SEQ ID NO: 2773 - DNA, 926 bp; single-stranded, linear
atagccacgactcaaatatattgatcttagaatctaaaagacttaggtctgggcgcggtggctcacgcctgtaatctcaacactttgggaggccgaggtaggtggatcacttgaggtcagcagttcaaaaaccacctggccaacatggtgtaaccctgtttctactaaaaatacaaaaaattagctgggcatggtggtagatgtttataatcccagctactcaggcaggctgaggcaggagaatacccttgaacctgggaggtggaggttgcatgacctgatggacctcaacatgcacaccagtccgagcaacaagagcgaaactccatctcaaaaaagaaagaaagaaagaaactatattcaggccaggcatggtagttcatgcctataaccccagctctttgggaggctgaggtgggaggatcattgagcccaggagttggagaccagcctgtgcaacaaagcgagacatggagaatgtggaacgagggacccaggacccagagacagtgctggttgtcactacactgaataaatcaggcttgactttgttaggggtactgaatttttaaaagggttttagaaaactagaatttcccttgtcactcaccctaattgttatttttcaactaggtcacaatgacgatgtcagaaaccatgcaatgaaaccaataaatgataataaaggtaattatctaattacatgtttttattagaaccaacttttacattaaaaaaaagactcataggaaaagaaaactaaaacttgaaggactgtggataatttcccacctctcttaatgaccctgtacccagccgatgtgtcaatgaaggtagctagctgctttcaccagagatgctatctagtgtcctcagtgggaagtacctaaatcaaagtagggaagaactgggttatactcaaaaaa

SEQ ID NO: 2774 - DNA, 390 bp; single-stranded, linear
acaacaactctgtggtttctttaggcagagcctctgaactcagacgtgcagtacacggaagttcaagtgtcctcagctgagtctcacaaaggtaagtgccactcgagtgagtccccaggcattcgctttggcttgggtttaaaccccagtggtggcgggggtgctgtgttcagtgagaagagtctgtgcaccctcagtcgctccaaaggaagtgattagcagacctaccggcctgctaagactggaaggagcaaggcccctggcctggcctgtctctgagctgtaaaatttcaataatttaaaagaaaaaaagaaaaggccaggcactgtggctcacacctgtaatcctagcactttgggaggccaaggcgggtggatcacctgagatca

SEQ ID NO: 2775 - DNA, 250 bp; single-stranded, linear
tatattttatatattaatatataaatataaatacatatataatatataatatatgttttctttgtgtataatatatattttataatattttatatatttttattttttatttttatatattttatatataatatttttatatttatattatttatatattttttattttatatatatatatatatttttttttttctttgttgagacggagtctactctctgcccaggctggggtgcagttgcgagatct

SEQ ID NO: 2776 - DNA, 226 bp; single-stranded, linear
tgcaaacctctgcctccgggttaaagcagcattctcctccctcagcctcccgagtagctgggattacaggcatgtcaccgccacagccgggtaatttatttattttttttttgtatttttaagtagagatgggatttcaccatgttggccagcgtgaactcgaacttctgacttcaaaagatccacccccctcagcctcccaaagtgctgggattacaggtgtgag

SEQ ID NO: 2777 - DNA, 1147 bp; single-stranded, linear
gaattcaatttgagttttccagacccgtcctcctccttggcagctaaggagcagtgtgggaagtcaggcctgagcctcaggtgttccctctctgccttcctgtgggtggagagccaggtattaccaggtacgaaaaggggctttgtgggtacaaggctcagtggtgagtacatttgacctggtcttgaccaagccagttccctgctctcaagacttcctcctcctatggaggaggggttgggaaccacatccagctctgaccctagtggcaggcgaccaagtggtcacttggggtggaggaggggcaggaaggaactcagtaaatcctggtttgctgcatgtttgctctgagactaattgctgggaaaaccccatgacgttggaagccatctccttctctgttatcacagagaaaaacagaagccaaaataaagccccatccggaaacatccctgacagcagagacaaagagcctgccagcctggtttactcattagcaagcagctgctccctggagtgggtggggaggagaggtagtgatgagctgcaactctgcctgcccacccatcacttaactgggcagatttgggggcagctgcaactctagaagctccaccaagaagcagaaccccccaggcccaaacaccaagccctctccctccatttattcctcacctgccccagcccccactgtgggcctgggtgggagggtgagctggccgtgaccaccccaccatgcgcctggtatatggtgtttgatagcatttgttgcagtgtctgcgttgtttgtgcacctgtctgcctcacagcctggagctcctgaaagctggggaccaggcccgatcacctttcctcttccacagtgcggggttcacactaggtgtctaggattctgctgagtgagtgatttggccaggcctgacatcaagcagagggtgtcttggggatgtggaggatcccccaatagggttggggatccctacagcttcccttgagggccccacatctggtgccacagaaagagagtgaggggtgtgtgggcatctctgctgtcccagcagtgtggtgccctggtagctcagccactctactgagttccaaatcctgtttgggtgccctgggggaagtcagtgtaagggcctagtca

SEQ ID NO: 2778 - DNA, 2136 bp; single-stranded, linear
aaggagggaaatccacttgaccatggcacaggaaccccccttacccaatctgggccttccctttcccccatctgtaaaaggagaacagtgcccacacgacatcagcctcttttcctacagtgagccttcctggccctttgtgcagtagacaggagctgggaagtgcccaggttccatcctgtttcctcagggttggtgggtatgtatgtgtgtgcacaccctgtgtgcatgagtgtgtgcacacccagattgcatgtttgtacatacagtgtgtatacaatgtgtgtagacacatcctatacactgtatgagggtatacatagcatgtatacacattgtgtgcatgagtgtgcgtgtgtatatgctgtgtgtgtatttttgtatacacatcctgtgcccataccccagtgtaaggtaaacagatggcaggaagggcgcccttgagtctcctccaggtatacgccacaccctgggtcagtcatcatgctgccatattgagagggtctagcccagaggatctcagccctgtctgcatattagggcccctgaggagatcctaaaaaaccagcaccagggacccccccagaccaatccaaccagaagctgcagtgaggcccaggagccagcagtgaaaacagccagcccagctgtctatctctgtaagagttctcagtcccagctattcctagggtcactgacaacccccaggctctaacccagacctcaggatcttgttctggatcccggggtctgggctctcaggtgattgggaggccatagcccaaccctgcgttgagggacctggcagaatgtctggacaagggtcacggtggcaggggaagaggagtgggggcagcaagctggaggctgcaggcccttgctggggggctctccatccgtgggcccctcaggtccaggggttcctctggtgcatgtggccctgctccacaatggcctgctgacctcctattcccagactgggagtgacgctcgttagaccaagacctccttcttcttcttcttttttttttttgggaggtggtgtgtcactgtgttgcccaggctggagtgcagtggcgcaatcttggctcactgcaacctctgcatcctgggttcaagcgattctcgtcccttagctctcgagtaactgggatcacagggacgcaccaccatgcccggttaattttttggaatttttagtagagacggggtttcggcatgttggccagaatggtctcaacctcctgacctcaagtgatcttgccccctcaacctcccaaagtgctgggattacaggtatgagccaccttgcccagccaggatcttctaacatcagaaatgacaaggtctctgggtgcttctggacctggttctggtggggtgcagtggtggggtacagccttgcctgcagagcctcagaccttttcctatgactgcagtggactgacctcgttcccagaggcagctactaacttatgcctggtcctttttccagatctaggaaagaaggacacagagacagtgtacagtgaagtccggaaagctgtccctggtgagtgagggtctccagtgccccagcctgggggatgccccctataatcactgatgggggcttgggagtgggcagagaaaagaagaagcaaagaagggcaaaaaaggggtggcacctcttacaccagcgctgtgggcttcctctctcccaccacccttaaaaagtcacctcgggtcacatttactattcatgtagtcaacgagcgcttcttgaatgcttactgaccccagccggtgacccttacctgctccccacacaggccctggtggctggggttccccaaggtcttggacgtcgagtgttttgctttggagacccccagtagcttcagcctttcttcttgttttcttttttctcttttttttttggggatacggagtctcgctctgtcactcaggctggagtgcagtggtgcaatctcgactcactgcaacctccacttcccggatttaagtgattctcctgcctcagcctcccaagtagatgggattacaggcgcctgtcaccacactcagctaattttttttttttatatttgggagacagagtttcgctcttgatgcccaggctggggtgcaatggag

SEQ ID NO: 2779 - DNA, 1183 bp; single-stranded, linear
tgctgggattaccaagtgtgaccccccgccccagcagcttcagcttttctgacaagaagactgactttgggagtgggtgtgggtttgcggatctactctatttcctttggttcggctgcccccacttcgcttcccgtgacgacccactgcttactcatgaaagggcttcccccagagctgagcacagagcttaagcagacccggaactgggggagctcaacaagtcctttttttcggtgggggggtataataactgtattcaattcaggtgaaatgaaatacacaatgacaacttttaaattctgaaggtaagtcagcaatccgaaagacgtaaacattgtgggggaaatagtgactgtgtgagtatctcgctttgtacagcagacctctatttaagtgggttcttggaaagggaatcattaaaatggtccaggacatttctgcaaagggtgcctactcagcctaggcgtggtggctcattaagcactcagtaagtgctttatttatttaccccaaataaataaataaatataaaaggatgactcctccgagtacagtcgccaaaccagcagcagcaatctcgggcccagcccagacccacaaaactagtctctggaatctgaacttagccagcttcagatgtttctgatgctgccaatatttgagaagcactgtttgtgttttgttttgtttttttgtttgaaacagagtctcactctgtcacccagactggagtacagcagtgccatctcagctgactgcaactccgtgcaacaccccccagcccctaaggcttaagcgatcctcccaagtagctagaaccacagacacacaccaccatgcccagctaagtttttgtatttttggtagagatgaggttttaccatgttgcccagactggtgttgaattcctgagctcaagcaatccacccccttcggcctcccaaagtgctgggattacaagcgtgagccactgtgccaggcaaaaagcactgttttagaagaaccatccaattctctgaggaccctgctttttatctgaaatagcgatcacttcttaattcacttttaaaagttggtatatctacaagaagaatagaaactcaacccttgtggaacttgaccctgaataatttttgaaaaaccaattctctggggaatttttagctcaaatacctcattt

SEQ ID NO: 2780 - DNA, 209 bp; single-stranded, linear
aaaaaaaaaaaaaaaaagaagaagtagtttctgcttttagtcagataaacaagctctggggagacttccttctacatctgaaccagctcaaaacaatccttatgccaaaggggcatattttgtggtggcatattctgatttccttcatctgctttagggcagctggctgttcaagtgggttctctcggggtctccaggttggttctaga

SEQ ID NO: 2781 - DNA, 326 bp; single-stranded, linear
ctttctttctttcctttcttttttttttttttgagacagggtcttcgctctgtcacccaggctggagtgcagtggcgcgatcgcagctcactgcaacctccagctcccgggttcaagtgattcttctgcctcagcctcctgagtagctgggaccacagctactgccaccacccccgggtaattttttttgtatttttagtagagacggtgtttcaccatattggtcaggctgatctcgaactccagacctcaggtgatccacctgccttggcctcccaaagtgctgggataacaggtgtgagacaccacgcccggccagatcatat

SEQ ID NO: 2782 - DNA, 634 bp; single-stranded, linear
gatcctatctacgggaaacatgaagagtaatattctactgtggcctgggtgaccctgggcaagtcatagagcctctcaagaccttggtcaccttctctgtgagatgaggtatgggctggaggcaggtcagtggtcctcgggctttattaaaacatcaatagtttggcgcaccccactccctgtgaatttcccattcactaggtctggagcggtgccgaaaacgtgcatttctaacaggtgtccacacgcagctgctcgccgacacgctggggcccgggctttgagaaccactcttgatgcagcatgttcctttctgattgtgccacgctaaggctctgcttcttgttggaaggagtagggtctttctcaccctccagaaatcctggagggatctttcagcattggtgggcaggtaaaacccagaaacactgtgcttattagagggaaggttgtattgagtgacccccaataaaacagggggcccagggccgcgcgcagtggctcacgcctgtaatcccagcaatttgggaggctaaggcgggcggatcatgaggtcaggagatcgagaccatcctggctaacacggtggaaaccccatctctactaaaaatacaaaaaattagctggacgtggt

SEQ ID NO: 2783 - DNA, 1063 bp; single-stranded, linear
agataagcaatagggcatgggcaggcctgcctccaaggagcagccccagggccgaggagagagagctggcgctggcccaggggacttgagtttgatgggaaagcttgcagacagtgggggagctgcctggtctttccagtcttggcttttggctctaagcacagcttttttttttttttttttaattgttgtatcatgaggcgccttccactcagctgcctccccacgttaggggatggacacagcactggcagggatcctgtgtgtctcagtttccctattgactctctgtggcctagagatgtatggtagaattccacactatgctttttttccaccgtgtttttttttttttttttttttgagacagggtctctctctgtcacccaggctggagtgcagtggcgcaatcttggctcactgcaacctccacctccccaggcaggcccctctgactcagctgggactacaggcatgcaccaccagcacccagcaaaatatttttatattttagtagagatggggtttcgtcacattggccaggctggtcttgaactccagagctcaagcaatccgcccgcctcagcctcccaaagtgctgggattacaatgcccagcccacttttttttttactttttacaattttattcttaaaattgtggtaaaacacatatcacataaaatttaccattttaactctaagtatccagctcagtggcactaagactacacttttggttgtcatagcgtggtgaacagagaagagaatgctactgcgtctcgtggagagaggccaggggataccgctaaacatgcgacaatgcacaggacagtcccctccccaccacaaaacaccacccagcccaaaatttcaacagggccaccatggagaaaccctggccagaggaattcacctcctgcaactcctccaacaggagagctggttttcctctccagtaccagcttgtggctgccctctgtcttgggagggtgacttaagggcacatcccacctgattactgtgggctctggatgggtgctgagtcttggtctggggaacag

SEQ ID NO: 2784 - DNA, 1532 bp; single-stranded, linear
aaattacccaggcatggtggtgtgcgcctgtagtcccaccaacttgggaggctgaggcaggagaattccttgaatctgggaggcggagggtgcagtgagccgagatagtgccagctgaggcaggagaattccctggaggtagaggttacggtgagccaagatggcgccaccacactccagcctgagtgacaaagcgagactctgtctcaaaaaaaaaaaaataaagaaaattttaaatgaagtgccagggactttatgcgcatgtcatgtggagctagctacagggtcccggggaagctgtcttgcacaaaggagccataaacctctaagggcactgccggctgatgtctcctggctctcgcctcctccctcttttctcgacctgctcctgaccctgtgatgttgttggggcagttgaactgggttatttgcgttgctcactgccatgtcatcctttgttttgtagatgccgtggaaagcagatactctgtaagtacacatttcatatacattatatttaaaagtactccactgaacagtgaaatatttccagactcacccacgcctgcattcacacgaattcttccccgctccctagcctgttcagaccagaagccctgggcttctctgactagccttggccagttctgatttcgaatattctctcctgcaatttccatcattacatctcagcccacacgtgaagggattgggactctggggtgcttagcgccaaacaagcaaagcacacatttcgtttaacgccaaagtctaggctctggaagtgaggcagatctagggtgtatgcttggaggagtggagcagctgacagctcattgcaatttagccgatactaattaccccctacacaccaggccatcagctgcaggaggacacccaagcttcttgacctcagttcaccttctgatgagggaatcagacatgtgatcacttatcataaagccaagtgagctatgccagagcctatgggaacacagaacagagacctagctagtgccctcttccccaaggaatcatttggaatggcccatgaagaatgaatggagtgatgatgccagcattgagggagaaagatcagcaggagcacaagggtgagggatgaccagtttcaagcagtgtgggatgggaaagaagagtgtgacagtgacaagtgacgggagaaagataagtcagggcttaaatccaaaggatttacatcccttgttaagaagcttcattctgtaggaaatggagttaggaatctgcatttggcagatgggagggtttatgaaagacacagaggcccacgttcaacttttgcaaagacgtgtcttccaatcccaacctttttgtgagctacccagcaatgcaggagttaactgggcagctaatatctgaagaaatgaggcatttgccgcataaacttcttttaggtctgggaagaactttcagcaaagatttcaggtagctcttccagtggcccctggcttcctttgttttgcccatgtcaggactcttgtaaaacagagctc

SEQ ID NO: 2785 - DNA, 492 bp; single-stranded, linear
gagctccagctttccagctgtcttttgggtgagcctgtcttcctcaagctcaagcttccttatctataaagtggagatggtgatgacaatgatgataagagcaacctattaggattttaaggatgaaatgagcaactgcaaccaccatataaaagctgcaagctgcaaaccaccatataaaagctggttgatctcaagctcttttcatcacttgggcaatagtaggtgtggatgggggacttaacttgatttggccatgaaatgaccctgccacatatggagaatgtagcagttgcttacccaaggcataggattcaaccaaggccaggctttgacttaggaatcagagacccacattaacatttgacttcccgcttcttagccatgtcaccatgggcaaatttcttggcctctcaagacctctgcttcctaatctgtaaactgggaatcataaactccctcacttggttgttgcaagggttgaatgagcac

SEQ ID NO: 2786 - DNA, 2069 bp; single-stranded, linear
ctatcaatctccagagctttttctttttaagtgtgagcgagtttattagagaagtaaagagacccaagagtgcctactccatagacagagcagccactgtgacactgtacccattaaacactaactctccattgcccctccagcaacccctagcacccactgtctactttctgtctctatgtggttgtctatttgagggacatcacataagtggagtcatatatttgtcctttcatgtctcccttatttcatttagcataacgttttcaagggtttcctgtgttgtgaatatatcagaatttcattctctttttaaggtagaatcatatcattttaaaacatttcagttggaccatctaagttcagtccttcattttcaacaattaaaaaacagccctcaaccgggtgcatctcacgttagctagagacagaactggagctagaagtcagatctcttaccaaagttgcctttcttcttctgtgggtaagtggggcacccttgggacgctgtgctgggcgtacatgggtgcttgatgaagttacttggtggactgatgtgattgatgtccaacatgtatgcagggacagaggctatggtccctacagagcaggcatggagagaaggagaaatacatacgggcaggagccaggagagggagggtgtagtgagcagagaccgcgccactgcactccagcctgagtgacagagtgagaatccatctaaaaaattgcttactaaagaagtggtctcctgaggtcttaagacgttcctggcaatgtcttgagtgggtgggagagagcctccagtcattgagctgtggaatttcagaggtgagaaccacacctaacccccaattactttcccctgtttgcctcagtgacacagctgcaggaaccctggtgggtgttgtattaagtaaatttgacctttattctttgcagatctgtgaaatgttgtcttctgaggggccacgtgtatctgtagtgctgaggactccttggggcctctgaagtcacagagagaacctgcagggtgggggaccagtgtgtgacagccctgctttgcattttctttgagaagtgctgtcattttgcatttctctccaccaggggaatcttcaatcttgagaggtgtgatcataacttgccttgtttcttgtcgctacagagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattgggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgaccagacagcctccccctgtcccctctatgacctcgccctccacaaatgggaaaaccagactacttgggagcaccgcctgtgaaataccaacctgaagacacggttcattcaggcaacgcacaaaacagaaaatgaaggtggaacaagcacatatgttcttcaactgtttttgtctacactctttctcttttcctctacatgctgaaggctgaaagacaggaaagatggtgccatcagcaaatattattcttaattgaaaacttgaaatgtgtatgtttcttactaatttttaaaaatgtattccttgccagggcaggcaaggtcgtcacgcctgtaatcccagcacttcaggaggctgaggtgggcggatc

SEQ ID NO: 2787 - DNA, 2557 bp; single-stranded, linear; identical to SEQ ID NO: 2757

SEQ ID NO: 2788 - DNA, 41783 bp; single-stranded, linear
gaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccaggtgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccacgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctaacaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcggaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagatgatccctgtatttcaagacctctgtccgaattccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagctgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggcccgggttcaagcgattctcctgcctcagcctcttgggtagctgggattataggcgtgtgccaccgtgcctggctaatttttgtatttttattggagacagggtttcaccatgttggccaggctggtctgaaactcctgacctcaggcaatcctcctacctcagcctctcaaagtgctgggattaccggcatgagccacgactcccggccccaaaggtcaatcttaaagctacaaggtatcttttaaaaggagtaggaataacgtattttgaggcttaaaggagtaggaatagtgtatttttagatttgaagccatcttctaaagggtacgatatttggttaacatgtcactccttatcgccatggaagaagttaattctattcttttttttttttttttgagatggagtctcactctgttgcccaggctggagtacaatggtgtgatctcagctcactgcaacctctgcctcctgggttcaagcaattctcctgcctcagcctcctgagtagcagggattacaggggttctccaccatgcctgtctaatttttgtatttttttttttagtagaggtggagtttcaccatgttggtcaggctggtctcaaacccctaacctcatgatccgcccgccttggcctcccaaagtgctgggattacaggcgtgagccaccatgcccagccgttaattctattcttactgcttactcccttattttgtatgttcttcttctatcttacatcttttgcttttgctattgcttaagctagcctacgccaagggtgctctttgccccctacttcctctgctattctcgcctcagttccgctgcattccaagctcagcctgccccagcagcaggtctctttgacaaacctgcaattttggggaaaagtcagccccaagaaaggcagggggcccagacttatgctgtgtggcaaaagccctctttgatgggggaaggggaggactggaaaagcagagagatctttctggatgtcctgggagagcagccctttgggtggtgggtggaggctggaggcagggaggaatcccctcacagtgccatgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgtgagtgtttactctgtttccacatcactttaactccatgagcatcgaaggaattccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagctgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagaggggtcttttggttttgctattgcttaagctagcctacgccaagggtgctctttgccccctacttcctctgctattctcgcctcagttccgctgcattccaagctcagcctgccccagcagcaggtctctttgacaaacctgcaattttggggaaaagtcagcccaagaaaggcagggggcccagacttatgctgtgtggcaaaagccctctttgatggggcaagggtaggactggaaaagcagagagatctttctggatgtcctgggagagcagccctttgggtggtgggtggaggctggaggcagggaggaatcccctcacagtgagaagggcccccaaacccaggcgagacagagggagggtcaagaacgccaaggcaaatgtcacttgtgccttgttttttccctaaagaaactaaacaaagcggccgcgttcggtggcccctcaggaaggccggtcatttcctgaggagatatcaggccagcccaggccccattgttcccggtttccagccatggctgccattacctgaccagcgccacagccggtctctctgcaggcgccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgtgagtgtttactctgtttccacatcactttaactccatgagcatcgaagcttctggaatcaacatgtttcttatgtttcttgcaggttcaagccttgagggtcaagaaaactgtaagtctgatgtttccactgtaacagatgtttctacctggcttcctcctttctcttctgtgatgcctaaaacgcacattaaattgctggggtttgatacttctaacaattaaggaaaagaatccaattgagaactaaagtttatcccatgtgggcatttttagaaaggcttagatctaagccaagttctggtcagtgtgttttagaagtagcacacgtttccttggctggtctgaaagtagtgggttatcttgatgaattgtttagtcagttacagatcaaactccatgttcttttctctgttctcacgactactcttgactagtctaaaaatatattaggttgttgaaaagtaattgtggtttttgccattactttttaaaagatggcaaaaaacacaattataagtagcacacattttcttttttttttccttttttttttgagacagagtctctgttacccaggctggagtgcagtggtgcaatccggctctctgcaaactccgcctccagggttcaagggattctcctgtctcagcctcctgggtcgctggaattagaggttggcaggctggtctcaaactcctgacctcaggtgatccgctggcctccacctcccaaagtgctgggattacaggtgtgagccaccacgcccggcctcacattttctagatttcagtgcattgctgttttttgggatggggaagtgatttttttattttaatgagcaattccataattagttttttgttgttttaccataatggcttatttgaatattgtaaggtatccccaactgtttttatttgcaaatgagatataattgatttgttagacatatgaagacagatcctagtttaaattgttgctactttttttactcctaaatgataaaaatcacacactcgagctcgctgtcccacagcccacccttcatcacaatagtcctgaaactttttgggttcagtaaggaaatctgtgggccttctctccagaaaaagcacacatttgcacacaattggaggtagttgatgagcctcctaacacccacccatgcacctcccaggggctgtgtcccccaggttgtgaacagtcactctgtgtaaatagtgagacctacaggcagtaattcagtttggctgtgcttggctggtttatttagaaagatgataatgtttgagctctccaagggcagacactgccagcctcactgttctctgaacccccagtatgggacagtgcttggcacagaaaaacccccttaaatgtttgctatgaatggtgctaaggaagaaggcagagaatgtcaaccagaggccaggcactggcaatatatacacggccccataccttggctcactgcaacctctgcctcccaggttcaagcagttctcctgcctcagtctcccaagtagctgggattacaggcgcccaccaccacacccggctaattttgtatttttagtagagatgaggtttcaccatgttggccaggctggtcttgaactcctgacctcaagtgatccacccgcctcggcctcccaaagtgctgggattacaggcataaaccaccgtgcccggctggtccagagctcatccagcaggcttcttaaatcaggagcttgtaagttgcatataaagacaaaaaagggagttccaaagagtaatgctgtgggaaatgacttgaatttaaaccgtcaccttgtttgatctcatggactggtcagacaccatttttgttgtcgttgttgttgttaaattaattgctcagaatatagcagcaggcgcaaattgtagtactcgttttaaaattgaagattaaattttaaattacccaacaaaggcctaactttgttaaaaggaattctaccgacagcctatggttactggatataagccaattctgttctggggacttgccagaaatgacacaattggccagttgacccacagcctagttcctagcagagattggatagctgattgagcgttgtggctgttttgaggcttgaccagagattcctgccgttggcagaggggaatctgtagtctttgcttcttggtagcaggtgaggctgaaaacgcaagtagcaggctaaaaactggtttcaagtcctcaccatctggtgaaacctcagagcccatcagatagaaaatgccagctgggactgtgctaattcggtaaggcctgggtggagaaggagggcctgggcacgaccatctggtttcggaatggaggtagcagtcatttattaagtacttaatgtatatcgggcactgtacaggagacgttctggctgttctcctgtacatttcctgcaaagacctaatgagatatgattactccatcctacaggtaaggaaactgagctcagagagtctagctgcccagggtcacacagtaaatgatgagccaggacttgaacacttgactgcttgaatcctgtactccctccaggggccaagatgtggcagctcacagaatgcctatatctttttttttttttgtcttttgagacagtctcactctgttgcccaggctggagtgcagtggtgagatctcacctcactgcaacccccgcctcccaggttcaagtgattcttgtgcctcagcctctcaagtagctgggttacaggcctgcaccaccaaacctggctaatttttgtatttttagtagagagggggtttcaccatgttggccaggccagtctctaactgctgacctcaggtgatccacccaccttggtctcccaaagtgctgggattataggcgtgagccaccatacctagctctacatctttatcactctgttcctttgccttggtgggaaaagttgcagcttagtaccaactgcctcctgcttgagccactgtgcacagttactatcagcctggccctgtaggcacgtagaacccctggactcaatactgcataggatgggataagaccacatctgatgtggtgaaggtcaccgggatgatgttgtttctgagataacaggtatgtctgccttccttcgggttgcatttagctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagctgttggtggaaggtgagtccttggaactgagcacaggcaagcagatggagcatagcacacagtggcgtgaataacagctgtgaatgaatagtgacactggacttaactctccacccatcaccctctcattcatctgcctggcattttccttacctgaatacgtaagcactagacatattccccaataggcaggcccttccttccttccttccttccttccttccttccttccttccttccttccttccttccttccttcctttctttctttgatggagtctcactctgtcacccagtctggagtgcagtgggtgatctcggctcactgcaacctctgcctcccaggttcaagcgattctcctgcctcagcctcccaagtaattgggattacaggtgtgtgccaccacacctggctaattttgtatttttagtagagatggggtttcactgtgttggtcaggctggtctcgaactctgacctcaagtgatccacctgcctcccaaaatgcttcttcatctcgctctataaattacaatttctttcttcaagactcaactcaatgatgttttgccaaaacaaaatgggtctaccccagggtgccagtcagtacagctctgatgctctctctacaggcaatggtatttgtgtgtataaaggccacagcggtgtgttaagacacctcgttctgcagtcactctgcctgggtttcaatcttgggtcaagtccttaacatgctctaaacttcaaaatcctcaccagtaaaaggaagataacaacgatacccatttcaggcaattattgagagggttaaaagtgtcatgtgggtagagtgcttagcaaaatttccagcacctagtgagttcctaataaatagaaatgtatttatttatttgagacagagtcttcctctgtcacccaggctaaagagcaatggcgcgaccttggctcactgcaacctctgtctcctgggttcaagcgattctcctgtctcagcctcccaagaaactgggattacaggcacgcgccactgtgcctggctaattttttgtatttttagtaaggatggggttttaccatgttggccagcctggtctcgaactcctaacttcaagtgatttacccaccttggcctcccagagtgtcaggattacaggtgtgagccaccatgcccggtccacaaatattctatttcactcagtattggcatccgttcttacacatctgtctgctcttctggatagtgaaattgtaaagacagagatggtgtttgggtttattcttatatcttgaacaatgaatctggctcatagtaggcattcagtcaatgttcatggaataaattaaagtcagtcctagcctgtgggtgcattcaataaagggtaacaacaatcacagtgacactgacaaatactgggttacctttcccctctaagcatcatctgttgggaatctgattgtgtcctcttcccaataggattataaaccattgaaaacaccaagtacatcttgaccatattttattttttaaatttatttatttatttatttatttatttttagacagagtctcactctgttgcccaggctggagggcagtggcacgatctcagctcactgcaacctctgccttcggggttcaagcaattctcctgcctcagcctccaagtagctgggattacaggtgcctgccaccatgccggctaattttgatttaatagagatggggttcgccatgttggccaggctggtctcaaactcctgacctcaggtgatccacctgcctcagcctcccaaagtgttgagattacagatgtgagccacctcgcgtggccttagtggtgattttggtggacccatcacccgagcagtgtacactgtacccagtgtgtagtcattttatccctcgctccctcccactctttcccctgagtccccaaagtccactgtatcattcttatgcctttgtttcctcatagcttagctcccattgagcatattttatattttttcctttcttttcttctcttttttgagacagggtctctgttgcccaggctggagtgcagtggtgggattactgctcactgccgcctcaacctcctaggctcaagtgattctcccacctcggcctcccaagtagctgggactaccagtgcacaccactaactacccctggctaattttaatttttttttttgtagagatagcatttcaccgtgttgcccaggctggtctccaactcctgggctcaagagatccacccacctcagcctccagattttatatatttcaaagtgcctagtactgtgctgggcacatacctgttcatttattacctggtaggtcgcactgggtgttcagagaacaaaaaagagccctctcatgggatcaactacagtcactcagcggaggggagggcttgtgtctctcaatcaggctgatactgacagactttcttcttcaatcaggctgatactgacatgactttctactttccccgtaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacgggtcagcatctgctcccttcctcatcgttctttgtggtttctggtgttctagagaagaaaggttgaattttaaagttagttaggaacaatagaaaagtttgaaaaggggaagcagcaaaaagagcagaagaggctcctcttgcccaggtttgcacctgagtccaaccaggttgtcttcctctcttgcagaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacaggtagggctgctgctgccggagggtgttggcatatggcgggctcaagaggccaccatgctgcaatccagcatggccaaagagagctgatcatttcctgcccctgcttatctgaatgaatgtgctcagatggggctttggtgctcgtgggaggaaaccactgcagagcgagttaacagtctactgtgcgtgttgagggtacaggctccggcaccaaagcttaaccctgccgctcactgcttctgtgaccttgggtgagttattgaacgtgccgcagcgctgtgagatggtgataatgaccttttaggactgctataatgattaatgagataactatactgtaagcatgagctgagagatttgtacagagtaagactctgaaacactggttaatgttttcattactctgttatatttctccatcccctgtgacaagcactatgctagatcgaattccggcctgtgaatccatctggttcttggactttttttggttggtaagctattgattattgccacaatttcagatcccgttattggtctattcagagattcaacttcttcctggtttagtcttgggagagtgtgtgtgttgaggaatttatccatttctcctagattttctagtttatttgcgtagaggtgtttgtagatattctctgatggtagtttgtatttgtgtgggatcggtgatgatatcccctttatcattttttattgcgtgtatttgattcttctctctttttttctttattaggcttgctagcggtctatcaattttgttgatcctttcaaaaaaccagctcctggattcattaattttttgaagggttttttgtgtctctatttccttcagttctgctctgattttagttatttcttgccttctgctagcttaaggagtttcattcttgttgcccaggctggagtgcagtggagcaatctcggctcactgcaatctctgtctcctgggttcaagggattctcttgcctcagcctcccgagtatctgggattacaggcgcccaccaccatgctggctaattttatatttttagtagagatggggtttcaccatgttgcccaggctggtctcaactcctgacctcaggtgatccacccacctctgcctcccaaagtgctgggattacaggcatgagccaccacacctggccacaagttgcaaaacttttctaatccttgtcattgaaataaattggattaacaagaaaggaaaacctgccattggaatcctaggcaaagaatgaaccctagctccttactggggtgatcgttaggtacatgagaagcaaaggaaaactttttgctggaagttggaagttggttctgccaagagcacctgagccaagggcctctccaggaagggtctttagggtggtggccagacacatctcgctccattcccactcactgtttttcagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtggtgagtatattgttgcgactcagaggacatccggggttgaatgggagaaaggaaatttatctgcagctgccgccctctccggtctccggtctgagcagactcaggcagggtaagaactagagggagagaagtgcgaaatcaaaggccaaagaaacaaggaggtattcctgctcagaacactgattcactgatgatgatgtggcctctgacttgcaagattctggcaagattctgcctcctggagcaagacccacccaaaagttcaggaaggaaacactacttagtcaatgttaaacttttcttttttttttttgagacgtgtcgcccaggctagagtgcagtggcacgatagctcactgcaacctctgcctcctaggttcaagtgatctcctgcctcagcctcccaagtagctgggattacaggtgcccaccaccacgtctgcctaatttttgtatttttatttttattacttttatttatttatttatttattttttttcggtctgtcacccaggctggcagtgccagtggcacaatctgggcatcactggaaagcatccgcactcctgggtacacgagcattctcctgcctcagccctcccaagtgggtgtggactacaggacacaccgttcacttgagtccaggagttcaagaccagcctgagcacatagtgagaccctgtctctacaaaaaataaagaattagccaggtgtggtgtgcacctatagtcccagctactcgggaggctgaggtaggaggattgcttgattctgggaggttgtagtgagctgtcatcgcaccagtgcactccagcctgggtaatagagtgagaccctgtctcaaatacacacacacacacacacacacacacattttgttggctacttgttgtactttttctatgttttctgtgtctttgctcaacacaagaaaagtatattatgtgtgcatgtgcgtgtgagatatggtaaaatatgaacatgtatttctggggatgtaatgttttccttgaatttctgtcattctctgttttgcttattgtacttctctttccctttcccttctcaccacacacacacacacacacacacacacacacacacagcctgtcagtctcataggtgtcctataaaggtaaatggcaggcaggcatttgaaattacagcagggatagaaagcaaaactcaggctttggaggaggaacctcttgtgctggatgctttgtttttaccttcagtgccttttggattgtttctccctctgttctagaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccacgccaaaatgttaagtgaggttctgagggtgaaggtgataggtaagttgctgtgctgtgagaagaaatcatgtgggcttggggcattctttcacccccagggactgtggggacaataagagaagtagggggccaggtgcggtggctcatgcctgtaatcccagcactttaggaggccaaggccggtgaatcattgaggccaggagttcaagaccagcctggccaacatggtgaaaccccatctctactaaaaatacaaaaattagctgggcatgatggcgtgcgcctataatcccagccactcgggaggctgaggcaggagaattgcttgaacccaggaagcacaggttgcactgagccaagttgcgccattgcactccagcctgagcaacaagagcgaaactccatctaaaaaaaaaaaagcgagagaagtagtgggtgcttatgcaaagtccatatactagatatgcaccaaagcagggccaaggttcagtaaaggaggctggaaaatatttgggggctattgatgaggacaatataatctctttccagaacctttcaacaaactgctaaaagatgataagcatgaaagtgtcctgactgcaggaagcactgaagttgtgcatatgggcttcccttagcactttctccttttcagatacactgttctgagaattgtagatcaggactctgctgttgtgactcctagccggggaaccctgccttgtgtgaattcgagattagcctggccaacatggtgaaatcctgtctctaataaaaatacaaaaaattagctgggtgtggtggtgggcacctttaatgccagctactcgggaggctgaggcacaagaatcatttgaacctgggaggcagaggctgcagtgagccaatatcattccgctacactccagcctgggcaacggagcaagactccatctcaaaaaaaaaaaaaattaacattacatagactaagcacctaatggtgtgaggcatacaaaaaagaagacatattctttgtttcaatgctgtggtaagaaacacaagctctcctaatgaaaatgatggacaaacatctgaatcatactaccaataagcatagaaaaaatgttgggggtcatgtttggttgtcacgtgaactatatccttacagtgatggtgatagtaatttagggtatgccagacttcatctagcttaagtgggtaaacattgtgaaaaagctgggctaggtgccagggcttgagaatgggtggccagagaaggctgaagatggctgaacatctccagcaaacacatgagccaaaaggtcccatggggcacttcaaaagactgtgcgcagccaggtgcggtggctcacgcctataatcccagcactttgggagaccgaatggggtggatcacttgagcccagaggtttgtgactagcttggccaacatggcaaaaccccgtctctactaaaaatacaaaaattagcccagcgtggtggtgggtgtcctgtagccccagctactcaggtggctgaggtggtagaatcacttgaatccaggaggcagaggttgcagtgagccaagatcgtgccactgcactccagcctgggtgacagagtgagactctatctccacaaaaaaaaaaaaaaaaaaaaaaattaaaggactgtggccaaatcagatggctggaaacaaaggctggagtttgggaatggagaatcaccggatatgagctgaaaaagtggctgagcctaagcgtgacaggtgtcaggtgccagtctcaggagtaggcaattgtcctgcatgcagtgaaaagccagaagatggaaggaaggacaggatgcaaatgagttctcggaacgatccacctggtggctgggtcagggagcaggcatggtgacttcagacctcatggtacgttagaggctaatgtgaagcccatgtgaagctgttggtttaaactgggtcgatatcagtggcacacatttactgaccatgtgtccagccctgtgtgaagtactgtagtaaattgctccaatggaaactcacaataaccacagaaggccagtaacagcattgtcgttattttatcatgacgcaactgaggcttagggcagacagctggtgggtggtgggactgggatttgagcccactggtgtcccaggcccggagcttggcttcttccattgtcttaccacagcctgcactcacaggagagtgactcataagttacaataccatctgctgaccatctgctctcacactagaaggaaagtctacttggggagacaatttaggatccgaattttggtagttgaggatggagctaggaaaagcggatacaggaggtagccaagttctgcttggacctgcagggagtgaggctggccgggctccaggtggaaatccccaggtgaaaagggagacttggagttcaggaaagtaacctggactggagccataggtttaggtgtcagtggctcagagacagaagctcagcgtgtaggtgaaatcacccaggaggagaatggggatggaaaactgaggattgaattttgcaaaatgttcatacttccggggaaaacaaagaataaccagtgaataagaaaggggtgccaggtaagaagggaagagaatcagagtcatgaggaaccccagaaccccagaaaaagctgagttccacgtaagacctgggcaacagtgaagtatggagagcccaagattgggagcgtggaggaagagcatccaccactgaatttaatcagccccggactcagggacgttggttggggaatcaagtgaccttcccagtttcttcaaaacttgagagagagtgcagtgtcacaagattgtgactacaaaagagtgcagtcagatttcaggggtaacaagaaagtgtgaaataagggagtcaaagcataaaggaaaaaggagaaaaaatggccgatagctagagaaggcgtgggtcaagattgtctgtggcctggcatggtggcttatgcctgtaatcccagcattttggaaggccgaggtgggcaaatcacctgaggtcaggaattcaagaccagcctggccaacagggcaaaaccccgtctctaaaacaacaacaacaacaaaaaaatccaaaaagttagctgggcctggtgggcgcacctgtcattccagctactcgggaggctgaggcaggagatttgcttgaacccaggaggcacacgttgcggtaagctgagattataccactgcactccagcctgggtgataagagcgggactctgtctcagaggaaaaaaaaaaaagttgagcagtggctgtctcatgttcctcttcctctgcccttctttgctcagtgtgaatccttttcctgcttttcagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctaacaaggaacaggagggagagtattactgcacagccttcaacagagccaaccacgcctccagtgtccccagaagcaaaatactgacagtcagaggtgagtcagggtctccatagcaagctgtgctgtgggcccccaagggcaagaccagaaaacaccccccttgtaagagggagtttggggggagtctagcttatgtgactgaaggctaggagagtaatgtcctccaggctcttggttgcaagtgacagaaacccactcaaattaagtaaaaaagagaaatcgattattataaggaattgggagaatgtcacatcgttccaattacaaattgttggcagactcaccattgagtcatcttgggtcaaacatccaaccacagaccacctgtagccaaggggattgggtcacgcagaacagacatgattggggaaccacttatgtgggtgtgggggcggtttcctggagaagaagagggctgaaaacacatgccaaaaaggagtctactccacttgagccctggagttggagaccagcctgggcaacatggtgaaaccctgtctctacaaaaagtacaaaaataggctgggcgcagtggctcatacctgtaatcccagctactcgggaggctgagacatgagaatcacttgaacccaggaggtagaggttgcagtgagcagagcttgctccactgcactccagcctgggcaacagagcaagactctgcctcaaaaatcaaaccaacaaaaaatagctgtgtgtggtggtgtgctcctgtagtcccagctactcgggaggctgaggtggaaggattgctcaagcccaggaagttgaggctgcagtgagctgtcatcagcctctagcctgggtgacagagtgagaccctgttcaaaaagaaagaaaaagaaaagagtctacccagcaaagctggtttgttccctccttgaggaccacagctgacctctatttgtagcagaaacaatcatttctgcaccagctctgagtgcagaacccctcagaggtagatggatgctaaggcaagctgccagttacaagagctgtgagaatcagactgacttttgttgcttaaggcctgatattatttcttcctggcagaggaagagcctatatacaaaaaaaattttttgttttgttttgttttcagtcattcttgccccatggaagaaaggacttattgcagtggttatcatcggagtgatcattgctctcttgatcattgcggccaaatgttattttctgaggaaagccaagggtgagcatagttctttccttccatactgactggtcgtccttgccaggaaaccagccagggatgcgtggtgcttttctgacccctggattcagctaggcaaaaatgaaagctattattttcctcattgggcaaaccagaaaagataaaatttgggggaaattacatctttgtgtggttagaagaagccatttctgtagatttgtccacacctagtcctgtaatgcgtgtagagtggggtgcaagcgtcttggagacacacaaacatgcgcataacacccacatgttgcacacacacattgacctctttcttttctgtcttttgaaaaagagtgaatatatttgccttctttttctctctttttctgggtattcaatcttctgggaagtccaaacgtagctgaaaagagtgttccttcacagcttactaggagtaaaacaaaaagaaaagaaaagtgttttctatctattaggttagtgcaaaagccattggcgttttggccattatagtggtatggatgtgggtactgtatactgactttggtttttcgttttctgtttttaaagccaagcagatgccagtggaaatgtccaggtgagtgtatttgtaagaagggggcggctgctctgtgagcacggtggacatgtctggagggagattctggtcattaggaagttttcagtggctcttggcaaacttagaaaaatataggccttccttgggtgtgagttgtgtgtgtgagttgtgtgtgtgtgtgtgtgtgtgtgtgtgtgtgtatctccgtggaagaatgccaattgtcctttcatgggaaggaatggcttttattctgagatcatgtccttcctacatgattatttgtgaaatctccctttctttatgaaattataatggtagtagataattttttaaaatttgacaaaatagagttggcctttaaaaaatggttttactacctttactgttgttgaaatcccaaatcaaaagtatagaaatgattgctctgttccagagagaaacagtagcgtgggataagaatttcagggggcttggtagtagcctgtgaaggactccggtattcatgtgtgctttggtctgatgttatttaataggaaagttaaaaaaaaaaaaagtttttttacataatccttggagctgccaaaaaatatttgttttccaaatgagagagtaaagttttccttaccttggaaaactcttcctggttttctcatgatcttcccttgtttactttggtggtttggggttagaacaataacaacaacaaatatatctatatattgttttctgtttttatatttcattttaaaggccagcagtaccacttctgaactccaacaacgagaaaatgtcagatcccaatatggaagctaacagtcattacggtaaagtcatgttctcctgccatttataattccccccaacttgctacatacttccttacccctctcagaagcagaatatgtaagtggtgggattacagttggaagagaaaccctggcttcaacagggtacttcatctcatcagccactgggccatgtaatatacggaaacgtaaaaggaaaggtaacatattttattctaactttgccaccttccaaactccccgtagaagaaagatggagaataatcataatgccttcaaagactttgaacattgctccagcgtaatattataattctccattttcaagacagagacagatattgaatgaaacattggtaaacatcttctcagatggaattattacaagcacaagacagttttacttcaaatttggcacaaagggaaagcaatttcaatattctctcagtaaaggcataaataaagtgttccaactaagaaaatatctattcataaggctcatcagtagcttcagggtcagctcagctgaatgagtaggcagtcctaggagttcttaatcccaggttagtaagaaaattgctcaagcatttcagcaggatgctacttacttcccagaggggggtattattacatcacaaaaagtcctgtcccagaccaaatttggggacactcttcctcttatagccacgactcaaatatattgatcttagaatctaaaagacttaggtctgggcgcggtggctcacgcctgtaatctcaacactttgggaggccgaggtaggtggatcacttgaggtcagcagttcaaaaaccacctggccaacatggtgtaaccctgtttctactaaaaatacaaaaaattagctgggcatggtggtagatgtttataatcccagctactcaggcaggctgaggcaggagaatacccttgaacctgggaggtggaggttgcatgacctgatggacctcaacatgcacaccagtccgagcaacaagagcgaaactccatctcaaaaaagaaagaaagaaagaaactatattcaggccaggcatggtagttcatgcctataaccccagctctttgggaggctgaggtgggaggatcattgagcccaggagttggagaccagcctgtgcaacaaagcgagacatggagaatgtggaacgagggacccaggacccagagacagtgctggttgtcactacactgaataaatcaggcttgactttgttaggggtactgaatttttaaaagggttttagaaaactagaatttcccttgtcactcaccctaattgttatttttcaactaggtcacaatgacgatgtcagaaaccatgcaatgaaaccaataaatgataataaaggtaattatctaattacatgtttttattagaaccaacttttacattaaaaaaaagactcataggaaaagaaaactaaaacttgaaggactgtggataatttcccacctctcttaatgaccctgtacccagccgatgtgtcaatgaaggtagctagctgctttcaccagagatgctatctagtgtcctcagtgggaagtacctaaatcaaagtagggaagaactgggttatactcaaaaaaacaacaactctgtggtttctttaggcagagcctctgaactcagacgtgcagtacacggaagttcaagtgtcctcagctgagtctcacaaaggtaagtgccactcgagtgagtccccaggcattcgctttggcttgggtttaaaccccagtggtggcgggggtgctgtgttcagtgagaagagtctgtgcaccctcagtcgctccaaaggaagtgattagcagacctaccggcctgctaagactggaaggagcaaggcccctggcctggcctgtctctgagctgtaaaatttcaataatttaaaagaaaaaaagaaaaggccaggcactgtggctcacacctgtaatcctagcactttgggaggccaaggcgggtggatcacctgagatcatatattttatatattaatatataaatataaatacatatataatatataatatatgttttctttgtgtataatatatattttataatattttatatatttttattttttatttttatatattttatatataatatttttatatttatattatttatatattttttattttatatatatatatatatttttttttttctttgttgagacggagtctactctctgcccaggctggggtgcagttgcgagatcttgcaaacctctgcctccgggttaaagcagcattctcctccctcagcctcccgagtagctgggattacaggcatgtcaccgccacagccgggtaatttatttattttttttttgtatttttaagtagagatgggatttcaccatgttggccagcgtgaactcgaacttctgacttcaaaagatccacccccctcagcctcccaaagtgctgggattacaggtgtgaggaattcaatttgagttttccagacccgtcctcctccttggcagctaaggagcagtgtgggaagtcaggcctgagcctcaggtgttccctctctgccttcctgtgggtggagagccaggtattaccaggtacgaaaaggggctttgtgggtacaaggctcagtggtgagtacatttgacctggtcttgaccaagccagttccctgctctcaagacttcctcctcctatggaggaggggttgggaaccacatccagctctgaccctagtggcaggcgaccaagtggtcacttggggtggaggaggggcaggaaggaactcagtaaatcctggtttgctgcatgtttgctctgagactaattgctgggaaaaccccatgacgttggaagccatctccttctctgttatcacagagaaaaacagaagccaaaataaagccccatccggaaacatccctgacagcagagacaaagagcctgccagcctggtttactcattagcaagcagctgctccctggagtgggtggggaggagaggtagtgatgagctgcaactctgcctgcccacccatcacttaactgggcagatttgggggcagctgcaactctagaagctccaccaagaagcagaaccccccaggcccaaacaccaagccctctccctccatttattcctcacctgccccagcccccactgtgggcctgggtgggagggtgagctggccgtgaccaccccaccatgcgcctggtatatggtgtttgatagcatttgttgcagtgtctgcgttgtttgtgcacctgtctgcctcacagcctggagctcctgaaagctggggaccaggcccgatcacctttcctcttccacagtgcggggttcacactaggtgtctaggattctgctgagtgagtgatttggccaggcctgacatcaagcagagggtgtcttggggatgtggaggatcccccaatagggttggggatccctacagcttcccttgagggccccacatctggtgccacagaaagagagtgaggggtgtgtgggcatctctgctgtcccagcagtgtggtgccctggtagctcagccactctactgagttccaaatcctgtttgggtgccctgggggaagtcagtgtaagggcctagtcaaaggagggaaatccacttgaccatggcacaggaaccccccttacccaatctgggccttccctttcccccatctgtaaaaggagaacagtgcccacacgacatcagcctcttttcctacagtgagccttcctggccctttgtgcagtagacaggagctgggaagtgcccaggttccatcctgtttcctcagggttggtgggtatgtatgtgtgtgcacaccctgtgtgcatgagtgtgtgcacacccagattgcatgtttgtacatacagtgtgtatacaatgtgtgtagacacatcctatacactgtatgagggtatacatagcatgtatacacattgtgtgcatgagtgtgcgtgtgtatatgctgtgtgtgtatttttgtatacacatcctgtgcccataccccagtgtaaggtaaacagatggcaggaagggcgcccttgagtctcctccaggtatacgccacaccctgggtcagtcatcatgctgccatattgagagggtctagcccagaggatctcagccctgtctgcatattagggcccctgaggagatcctaaaaaaccagcaccagggacccccccagaccaatccaaccagaagctgcagtgaggcccaggagccagcagtgaaaacagccagcccagctgtctatctctgtaagagttctcagtcccagctattcctagggtcactgacaacccccaggctctaacccagacctcaggatcttgttctggatcccggggtctgggctctcaggtgattgggaggccatagcccaaccctgcgttgagggacctggcagaatgtctggacaagggtcacggtggcaggggaagaggagtgggggcagcaagctggaggctgcaggcccttgctggggggctctccatccgtgggcccctcaggtccaggggttcctctggtgcatgtggccctgctccacaatggcctgctgacctcctattcccagactgggagtgacgctcgttagaccaagacctccttcttcttcttcttttttttttttgggaggtggtgtgtcactgtgttgcccaggctggagtgcagtggcgcaatcttggctcactgcaacctctgcatcctgggttcaagcgattctcgtcccttagctctcgagtaactgggatcacagggacgcaccaccatgcccggttaattttttggaatttttagtagagacggggtttcggcatgttggccagaatggtctcaacctcctgacctcaagtgatcttgccccctcaacctcccaaagtgctgggattacaggtatgagccaccttgcccagccaggatcttctaacatcagaaatgacaaggtctctgggtgcttctggacctggttctggtggggtgcagtggtggggtacagccttgcctgcagagcctcagaccttttcctatgactgcagtggactgacctcgttcccagaggcagctactaacttatgcctggtcctttttccagatctaggaaagaaggacacagagacagtgtacagtgaagtccggaaagctgtccctggtgagtgagggtctccagtgccccagcctgggggatgccccctataatcactgatgggggcttgggagtgggcagagaaaagaagaagcaaagaagggcaaaaaaggggtggcacctcttacaccagcgctgtgggcttcctctctcccaccacccttaaaaagtcacctcgggtcacatttactattcatgtagtcaacgagcgcttcttgaatgcttactgaccccagccggtgacccttacctgctccccacacaggccctggtggctggggttccccaaggtcttggacgtcgagtgttttgctttggagacccccagtagcttcagcctttcttcttgttttcttttttctcttttttttttggggatacggagtctcgctctgtcactcaggctggagtgcagtggtgcaatctcgactcactgcaacctccacttcccggatttaagtgattctcctgcctcagcctcccaagtagatgggattacaggcgcctgtcaccacactcagctaattttttttttttatatttgggagacagagtttcgctcttgatgcccaggctggggtgcaatggagtgctgggattaccaagtgtgaccccccgccccagcagcttcagcttttctgacaagaagactgactttgggagtgggtgtgggtttgcggatctactctatttcctttggttcggctgcccccacttcgcttcccgtgacgacccactgcttactcatgaaagggcttcccccagagctgagcacagagcttaagcagacccggaactgggggagctcaacaagtcctttttttcggtgggggggtataataactgtattcaattcaggtgaaatgaaatacacaatgacaacttttaaattctgaaggtaagtcagcaatccgaaagacgtaaacattgtgggggaaatagtgactgtgtgagtatctcgctttgtacagcagacctctatttaagtgggttcttggaaagggaatcattaaaatggtccaggacatttctgcaaagggtgcctactcagcctaggcgtggtggctcattaagcactcagtaagtgctttatttatttaccccaaataaataaataaatataaaaggatgactcctccgagtacagtcgccaaaccagcagcagcaatctcgggcccagcccagacccacaaaactagtctctggaatctgaacttagccagcttcagatgtttctgatgctgccaatatttgagaagcactgtttgtgttttgttttgtttttttgtttgaaacagagtctcactctgtcacccagactggagtacagcagtgccatctcagctgactgcaactccgtgcaacaccccccagcccctaaggcttaagcgatcctcccaagtagctagaaccacagacacacaccaccatgcccagctaagtttttgtatttttggtagagatgaggttttaccatgttgcccagactggtgttgaattcctgagctcaagcaatccacccccttcggcctcccaaagtgctgggattacaagcgtgagccactgtgccaggcaaaaagcactgttttagaagaaccatccaattctctgaggaccctgctttttatctgaaatagcgatcacttcttaattcacttttaaaagttggtatatctacaagaagaatagaaactcaacccttgtggaacttgaccctgaataatttttgaaaaaccaattctctggggaatttttagctcaaatacctcatttaaaaaaaaaaaaaaaaagaagaagtagtttctgcttttagtcagataaacaagctctggggagacttccttctacatctgaaccagctcaaaacaatccttatgccaaaggggcatattttgtggtggcatattctgatttccttcatctgctttagggcagctggctgttcaagtgggttctctcggggtctccaggttggttctagactttctttctttcctttcttttttttttttttgagacagggtcttcgctctgtcacccaggctggagtgcagtggcgcgatcgcagctcactgcaacctccagctcccgggttcaagtgattcttctgcctcagcctcctgagtagctgggaccacagctactgccaccacccccgggtaattttttttgtatttttagtagagacggtgtttcaccatattggtcaggctgatctcgaactccagacctcaggtgatccacctgccttggcctcccaaagtgctgggataacaggtgtgagacaccacgcccggccagatcatatgatcctatctacgggaaacatgaagagtaatattctactgtggcctgggtgaccctgggcaagtcatagagcctctcaagaccttggtcaccttctctgtgagatgaggtatgggctggaggcaggtcagtggtcctcgggctttattaaaacatcaatagtttggcgcaccccactccctgtgaatttcccattcactaggtctggagcggtgccgaaaacgtgcatttctaacaggtgtccacacgcagctgctcgccgacacgctggggcccgggctttgagaaccactcttgatgcagcatgttcctttctgattgtgccacgctaaggctctgcttcttgttggaaggagtagggtctttctcaccctccagaaatcctggagggatctttcagcattggtgggcaggtaaaacccagaaacactgtgcttattagagggaaggttgtattgagtgacccccaataaaacagggggcccagggccgcgcgcagtggctcacgcctgtaatcccagcaatttgggaggctaaggcgggcggatcatgaggtcaggagatcgagaccatcctggctaacacggtggaaaccccatctctactaaaaatacaaaaaattagctggacgtggtagataagcaatagggcatgggcaggcctgcctccaaggagcagccccagggccgaggagagagagctggcgctggcccaggggacttgagtttgatgggaaagcttgcagacagtgggggagctgcctggtctttccagtcttggcttttggctctaagcacagcttttttttttttttttttaattgttgtatcatgaggcgccttccactcagctgcctccccacgttaggggatggacacagcactggcagggatcctgtgtgtctcagtttccctattgactctctgtggcctagagatgtatggtagaattccacactatgctttttttccaccgtgtttttttttttttttttttttgagacagggtctctctctgtcacccaggctggagtgcagtggcgcaatcttggctcactgcaacctccacctccccaggcaggcccctctgactcagctgggactacaggcatgcaccaccagcacccagcaaaatatttttatattttagtagagatggggtttcgtcacattggccaggctggtcttgaactccagagctcaagcaatccgcccgcctcagcctcccaaagtgctgggattacaatgcccagcccacttttttttttactttttacaattttattcttaaaattgtggtaaaacacatatcacataaaatttaccattttaactctaagtatccagctcagtggcactaagactacacttttggttgtcatagcgtggtgaacagagaagagaatgctactgcgtctcgtggagagaggccaggggataccgctaaacatgcgacaatgcacaggacagtcccctccccaccacaaaacaccacccagcccaaaatttcaacagggccaccatggagaaaccctggccagaggaattcacctcctgcaactcctccaacaggagagctggttttcctctccagtaccagcttgtggctgccctctgtcttgggagggtgacttaagggcacatcccacctgattactgtgggctctggatgggtgctgagtcttggtctggggaacagaaattacccaggcatggtggtgtgcgcctgtagtcccaccaacttgggaggctgaggcaggagaattccttgaatctgggaggcggagggtgcagtgagccgagatagtgccagctgaggcaggagaattccctggaggtagaggttacggtgagccaagatggcgccaccacactccagcctgagtgacaaagcgagactctgtctcaaaaaaaaaaaaataaagaaaattttaaatgaagtgccagggactttatgcgcatgtcatgtggagctagctacagggtcccggggaagctgtcttgcacaaaggagccataaacctctaagggcactgccggctgatgtctcctggctctcgcctcctccctcttttctcgacctgctcctgaccctgtgatgttgttggggcagttgaactgggttatttgcgttgctcactgccatgtcatcctttgttttgtagatgccgtggaaagcagatactctgtaagtacacatttcatatacattatatttaaaagtactccactgaacagtgaaatatttccagactcacccacgcctgcattcacacgaattcttccccgctccctagcctgttcagaccagaagccctgggcttctctgactagccttggccagttctgatttcgaatattctctcctgcaatttccatcattacatctcagcccacacgtgaagggattgggactctggggtgcttagcgccaaacaagcaaagcacacatttcgtttaacgccaaagtctaggctctggaagtgaggcagatctagggtgtatgcttggaggagtggagcagctgacagctcattgcaatttagccgatactaattaccccctacacaccaggccatcagctgcaggaggacacccaagcttcttgacctcagttcaccttctgatgagggaatcagacatgtgatcacttatcataaagccaagtgagctatgccagagcctatgggaacacagaacagagacctagctagtgccctcttccccaaggaatcatttggaatggcccatgaagaatgaatggagtgatgatgccagcattgagggagaaagatcagcaggagcacaagggtgagggatgaccagtttcaagcagtgtgggatgggaaagaagagtgtgacagtgacaagtgacgggagaaagataagtcagggcttaaatccaaaggatttacatcccttgttaagaagcttcattctgtaggaaatggagttaggaatctgcatttggcagatgggagggtttatgaaagacacagaggcccacgttcaacttttgcaaagacgtgtcttccaatcccaacctttttgtgagctacccagcaatgcaggagttaactgggcagctaatatctgaagaaatgaggcatttgccgcataaacttcttttaggtctgggaagaactttcagcaaagatttcaggtagctcttccagtggcccctggcttcctttgttttgcccatgtcaggactcttgtaaaacagagctcgagctccagctttccagctgtcttttgggtgagcctgtcttcctcaagctcaagcttccttatctataaagtggagatggtgatgacaatgatgataagagcaacctattaggattttaaggatgaaatgagcaactgcaaccaccatataaaagctgcaagctgcaaaccaccatataaaagctggttgatctcaagctcttttcatcacttgggcaatagtaggtgtggatgggggacttaacttgatttggccatgaaatgaccctgccacatatggagaatgtagcagttgcttacccaaggcataggattcaaccaaggccaggctttgacttaggaatcagagacccacattaacatttgacttcccgcttcttagccatgtcaccatgggcaaatttcttggcctctcaagacctctgcttcctaatctgtaaactgggaatcataaactccctcacttggttgttgcaagggttgaatgagcacctatcaatctccagagctttttctttttaagtgtgagcgagtttattagagaagtaaagagacccaagagtgcctactccatagacagagcagccactgtgacactgtacccattaaacactaactctccattgcccctccagcaacccctagcacccactgtctactttctgtctctatgtggttgtctatttgagggacatcacataagtggagtcatatatttgtcctttcatgtctcccttatttcatttagcataacgttttcaagggtttcctgtgttgtgaatatatcagaatttcattctctttttaaggtagaatcatatcattttaaaacatttcagttggaccatctaagttcagtccttcattttcaacaattaaaaaacagccctcaaccgggtgcatctcacgttagctagagacagaactggagctagaagtcagatctcttaccaaagttgcctttcttcttctgtgggtaagtggggcacccttgggacgctgtgctgggcgtacatgggtgcttgatgaagttacttggtggactgatgtgattgatgtccaacatgtatgcagggacagaggctatggtccctacagagcaggcatggagagaaggagaaatacatacgggcaggagccaggagagggagggtgtagtgagcagagaccgcgccactgcactccagcctgagtgacagagtgagaatccatctaaaaaattgcttactaaagaagtggtctcctgaggtcttaagacgttcctggcaatgtcttgagtgggtgggagagagcctccagtcattgagctgtggaatttcagaggtgagaaccacacctaacccccaattactttcccctgtttgcctcagtgacacagctgcaggaaccctggtgggtgttgtattaagtaaatttgacctttattctttgcagatctgtgaaatgttgtcttctgaggggccacgtgtatctgtagtgctgaggactccttggggcctctgaagtcacagagagaacctgcagggtgggggaccagtgtgtgacagccctgctttgcattttctttgagaagtgctgtcattttgcatttctctccaccaggggaatcttcaatcttgagaggtgtgatcataacttgccttgtttcttgtcgctacagagaacggaaggctcccttgatggaacttagacagcaaggccagatgcacatccctggaaggacatccatgttccgagaagaacagatgatccctgtatttcaagacctctgtgcacttatttatgaacctgccctgctcccacagaacacagcaattcctcaggctaagctgccggttcttaaatccatcctgctaagttaatgttgggtagaaagagatacagaggggctgttgaatttcccacataccctccttccaccaagttggaacatccttggaaattgggaagagcacaagaggagatccagggcaaggccattgggatattctgaaacttgaatattttgttttgtgcagagataaagaccttttccatgcaccctcatacacagaaaccaattttcttttttatactcaatcatttctagcgcatggcctggttagaggctggttttttctcttttcctttggtccttcaaaggcttgtagttttgggtagtccttgttctttggaaatacacagtgctgaccagacagcctccccctgtcccctctatgacctcgccctccacaaatgggaaaaccagactacttgggagcaccgcctgtgaaataccaacctgaagacacggttcattcaggcaacgcacaaaacagaaaatgaaggtggaacaagcacatatgttcttcaactgtttttgtctacactctttctcttttcctctacatgctgaaggctgaaagacaggaaagatggtgccatcagcaaatattattcttaattgaaaacttgaaatgtgtatgtttcttactaatttttaaaaatgtattccttgccagggcaggcaaggtcgtcacgcctgtaatcccagcacttcaggaggctgaggtgggcggatcgaattccgggagaagtgaccagagcaatttctgcttttcacagggcgggtttctcaacggtgacttgtgggcagtgccttctgctgagcgagtcatggcccgaaggcagaactaactgtgcctgcagtcttcactctcaggatgcagccgaggtgggcccaaggggccacgatgtggcttggagtcctgctgacccttctgctctgttcaagccttgagggtcaagaaaactctttcacaatcaacagtgttgacatgaagagcctgccggactggacggtgcaaaatgggaagaacctgaccctgcagtgcttcgcggatgtcagcaccacctctcacgtcaagcctcagcaccagatgctgttctataaggatgacgtgctgttttacaacatctcctccatgaagagcacagagagttattttattcctgaagtccggatctatgactcagggacatataaatgtactgtgattgtgaacaacaaagagaaaaccactgcagagtaccagctgttggtggaaggagtgcccagtcccagggtgacactggacaagaaagaggccatccaaggtgggatcgtgagggtcaactgttctgtcccagaggaaaaggccccaatacacttcacaattgaaaaacttgaactaaatgaaaaaatggtcaagctgaaaagagagaagaattctcgagaccagaattttgtgatactggaattccccgttgaggaacaggaccgcgttttatccttccgatgtcaagctaggatcatttctgggatccatatgcagacctcagaatctaccaagagtgaactggtcaccgtgacggaatccttctctacacccaagttccacatcagccccaccggaatgatcatggaaggagctcagctccacattaagtgcaccattcaagtgactcacctggcccaggagtttccagaaatcataattcagaaggacaaggcgattgtggcccacaacagacatggcaacaaggctgtgtactcagtcatggccatggtggagcacagtggcaactacacgtgcaaagtggagtccagccgcatatccaaggtcagcagcatcgtggtcaacataacagaactattttccaagcccgaactggaatcttccttcacacatctggaccaaggtgaaagactgaacctgtcctgctccatcccaggagcacctccagccaacttcaccatccagaaggaagatacgattgtgtcacagactcaagatttcaccaagatagcctcaaagtcggacagtgggacgtatatctgcactgcaggtattgacaaagtggtcaagaaaagcaacacagtccagatagtcgtatgtgaaatgctctcccagcccaggatttcttatgatgcccagtttgaggtcataaaaggacagaccatcgaagtccgttgcgaatcgatcagtggaactttgcctatttcttaccaacttttaaaaacaagtaaagttttggagaatagtaccaagaactcaaatgatcctgcggtattcaaagacaaccccactgaagacgtcgaataccagtgtgttgcagataattgccattcccatgccaaaatgttaagtgaggttctgagggtgaaggtgatagccccggtggatgaggtccagatttctatcctgtcaagtaaggtggtggagtctggagaggacattgtgctgcaatgtgctgtgaatgaaggatctggtcccatcacctataagttttacagagaaaaagagggcaaacccttctatcaaatgacctcaaatgccacccaggcattttggaccaagcagaaggctagcaaggaacaggagggagagtattactgcacagccttcaacagagccaaccacgcctccagtgtccccagaagcaaaatactgacagtcagagtcattcttgccccatggaagaaaggacttattgcagtggttatcatcggagtgatcattgctctcttgatcattgcggccaaatgttattttctgaggaaagccaaggccaagcagatgccagtggaaatgtccaggccagcagtaccacttctgaactccaacaacgagaaaatgtcagatcccaatatggaagctaacagtcattacggtcacaatgacgatgtcagaaaccatgcaatgaaaccaataaatgataataaagagcctctgaactcagacgtgcagtacacggaagttcaagtgtcctcagctgagtctcacaaagatctaggaaagaaggacacagagacagtgtacagtgaagtccggaaagctgtccctgatgccgtggaaagcagatactctagaacggaaggctcccttgatggaacttagacagcaaggccagatgcacatccctggaaggacatccatgttccgagaagaacagataatccctgtatttcaagacctctgtgcacttatttatgaacctgccctgctcccacagaacacagcaattcctcaggctaagctgccggttcttaaatccatcctgctaagttaatgttgggtagaaagagatacagagggg

SEQ ID NO: 2789 - DNA, 562 bp; single-stranded, linear
tggtcatctcagtttcttttctcaccttgactgcaagatgaaactccttgtgctagctgtgctgctcacagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtgctgccagacacatgacaactgctatgaccaggccaagaagctggacagctgtaaatttctgctggacaacccgtacacccacacctattcatactcgtgctctggctcggcaatcacctgtagcagcaaaaacaaagagtgtgaggccttcatttgcaactgcgaccgcaacgctgccatctgcttttcaaaagctccatataacaaggcacacaagaacctggacaccaagaagtattgtcagagttgaatatcacctctcaaaagcatcacctctatctgcctcatctcacactgtactctccaataaagcaccttgttgaaagaa

SEQ ID NO: 2790 - DNA, 3375 bp; single-stranded, linear
ctgcagaggctcaatcactgttcattgcagccttgacctccctggctcacgagatcctcccatctcagcctcctgagttgctgggatcacaggtgcaatccaccaccacacctggttaacatttttttttttagagatgaggtctctctatgttgcccaggctgcacttccttcttgtctcccttatcccagcgtccgactgaactgacggctttgctttccccaaccagcccgtgaagctgggctgagtacaaagtggtgggtatgagggtcaagattgtaagatctgaaaactccagaaaccatccctttggttaacagttgctaaggacaaatgcataacatattttccagtgatcccatgctggcaaatcgtgagggtcattcctgcaacagacagattcaaggccagccccaaactcagccaagagcaaagcaaacactccagccttatctgggcagggttgtgtggagactgactataagactatacctgagactggtcatctcagttcttttctcaccttgactgcaagatgaaactccttgtgctagctgtgctgctcacaggtaggcaagtctccccggctccacccgcctttctctcccaagtgagctaagatctcactcctctggaatgggggccacacacagcaaacagggatggccagccccgcagtctcaattcgaggttcccagtgggcttaagggctcctctattggggttccctcaaggctggcactttttcaacctgcaagtctgaactcagattgcctgagctaagaaagcttgcctttattttcttttttccagacagggtcttgctctataacccaggctggagttcagtggcatgatcatagctcaccacagcttccaactcgtgggctcaagtgatcctcccaccttactcaactaagtagttaggccaatctcccatttattttattttattttaatttttatttttattttactttattttatttttgagacggggctcactctgtcgccaggctggagtgcggtgggctgatctcagatcactacaacctccatctcctggttcaaataattctcttgcctcagcctctcaagtagctggacttgtagctctcaagtagctggcacacaccaccatgcccagctaattttttgtgtgttttttttggtagagacaggttttcaccatgttggccaggctgggtgacctcccttttagattctcctcatcctgctctattcttcccctttctaaatgcagtatccagtttccttacttatacactttattattattcttattattattgagacagagtcttgctttgtgcccaaggctggagtacagtggtgcgatctcggctcactgcaagctccacctgctgggttcacgccattctcccgcctcagcctccccagtagctgggactaaagcgcctgccaccacgccccgctaatttttttgtatttttaataaagacggggtttcatcgtgttagccaggatggtctcgatctcatgaccttgtgatccgcctgcctcggcctcccaaatgctggattacaggcatgagccaccgtgcccggccttatcacatttattatttattgtttttctctcccactaggttgtaagctccatgaggttagagattattattattattattattattattattattattattattattattatatctgttcactgctgtatctctagctcctaggacagagcctggcacatagtaagtgctcaataaatattcactggataaacagtgcagatagtttaaaactatctgacctagggaggctgaggcaggagaatggcgtgaacccgggaagcagagtttgcagtgagctgaaatcgtgtcactgcactccaacctgggcaacagagcaagactccatctcaaaaaaaaaaaaaaaactatcaggcctagctgggtggcacatgcctgtaatcctagctgaggcggtagggtcccagaagaagaagaagaagaaaaagaagaagatatatatatatatacacacacacaaagatataaactttatatatataaagttttcattaaaaaaaaaaaaaacctctacccactttcactttaccaggttcctgggtccaacggtcttcagaggaggcagctggcaggggtcagggaggcagcgtgggacccgagggagcaggaaggcagtgtgtccccggggtgctggcagaccgatttgaactctggctatgtcttcttgcagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtaagtgatccgcctgcaggaaaattggagtgcctgccgggggcggggtggggcaccacgccaaggatctcacgaggcatacaaaggggacttgcatatctgctaaggataacatattttcacctcttgtcaaataaacatatatgttccaagaggaccctgtagcgaacgcaccccgttagagatggaaacattgaccgacgtgcaaaacagtgggcgatgctgccctccagtggcagaatgtagcaacattaaacatcacagcacctatccacgtgtcattttctagcagtggttgtcactgccccttctggaatacaggattttactgtattcttgcaaccatgttaaaaatcgctttcaggccaggcgcggtggctcatgcctgtaatcccagcactttgggaggccgaggcgggcggatcacttgaggtcaggagttcgagaccagcctggccaacatggtgaaaccctgtctctactaaaaaatacaaaaattagccggacatggtggcgagcgcctgtaaccccagctacttgggagactgagttggaggtttcatgagccaaggtcgtgtcactgctgtccagcctgggtaacagagcaactctgtctcaaaaaaaaaaaatgctttcaataaatatatgataaaaggacttatattttttcaagccataggatcatttctcctgaagcatcttggcgaagtcatccccacctgttcctgagagtgggcaggtgagggctgacctattgctctgcacttactcctatctcagctgtccctcccactttccaggtgctgccagacacatgacaactgctacgaccaggccaagaagctggacagctgtaaatttctgctggacaacccgtacacccacacctattcatactcgtgctctggctcggcaatcacctgtagcagtaggtttatcccttccttgaccta

SEQ ID NO: 2791 - DNA, 2834 bp; single-stranded, linear
gcccactcccaccgccagctggaaccctggggactacgacgtccctcaaaccttgcttctaggagataaaaagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgattttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattctttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatccc

SEQ ID NO: 2792 - DNA, 6771 bp; single-stranded, linear
tggtcatctcagtttcttttctcaccttgactgcaagatgaaactccttgtgctagctgtgctgctcacagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtgctgccagacacatgacaactgctatgaccaggccaagaagctggacagctgtaaatttctgctggacaacccgtacacccacacctattcatactcgtgctctggctcggcaatcacctgtagcagcaaaaacaaagagtgtgaggccttcatttgcaactgcgaccgcaacgctgccatctgcttttcaaaagctccatataacaaggcacacaagaacctggacaccaagaagtattgtcagagttgaatatcacctctcaaaagcatcacctctatctgcctcatctcacactgtactctccaataaagcaccttgttgaaagaactgcagaggctcaatcactgttcattgcagccttgacctccctggctcacgagatcctcccatctcagcctcctgagttgctgggatcacaggtgcaatccaccaccacacctggttaacatttttttttttagagatgaggtctctctatgttgcccaggctgcacttccttcttgtctcccttatcccagcgtccgactgaactgacggctttgctttccccaaccagcccgtgaagctgggctgagtacaaagtggtgggtatgagggtcaagattgtaagatctgaaaactccagaaaccatccctttggttaacagttgctaaggacaaatgcataacatattttccagtgatcccatgctggcaaatcgtgagggtcattcctgcaacagacagattcaaggccagccccaaactcagccaagagcaaagcaaacactccagccttatctgggcagggttgtgtggagactgactataagactatacctgagactggtcatctcagttcttttctcaccttgactgcaagatgaaactccttgtgctagctgtgctgctcacaggtaggcaagtctccccggctccacccgcctttctctcccaagtgagctaagatctcactcctctggaatgggggccacacacagcaaacagggatggccagccccgcagtctcaattcgaggttcccagtgggcttaagggctcctctattggggttccctcaaggctggcactttttcaacctgcaagtctgaactcagattgcctgagctaagaaagcttgcctttattttcttttttccagacagggtcttgctctataacccaggctggagttcagtggcatgatcatagctcaccacagcttccaactcgtgggctcaagtgatcctcccaccttactcaactaagtagttaggccaatctcccatttattttattttattttaatttttatttttattttactttattttatttttgagacggggctcactctgtcgccaggctggagtgcggtgggctgatctcagatcactacaacctccatctcctggttcaaataattctcttgcctcagcctctcaagtagctggacttgtagctctcaagtagctggcacacaccaccatgcccagctaattttttgtgtgttttttttggtagagacaggttttcaccatgttggccaggctgggtgacctcccttttagattctcctcatcctgctctattcttcccctttctaaatgcagtatccagtttccttacttatacactttattattattcttattattattgagacagagtcttgctttgtgcccaaggctggagtacagtggtgcgatctcggctcactgcaagctccacctgctgggttcacgccattctcccgcctcagcctccccagtagctgggactaaagcgcctgccaccacgccccgctaatttttttgtatttttaataaagacggggtttcatcgtgttagccaggatggtctcgatctcatgaccttgtgatccgcctgcctcggcctcccaaatgctggattacaggcatgagccaccgtgcccggccttatcacatttattatttattgtttttctctcccactaggttgtaagctccatgaggttagagattattattattattattattattattattattattattattattattatatctgttcactgctgtatctctagctcctaggacagagcctggcacatagtaagtgctcaataaatattcactggataaacagtgcagatagtttaaaactatctgacctagggaggctgaggcaggagaatggcgtgaacccgggaagcagagtttgcagtgagctgaaatcgtgtcactgcactccaacctgggcaacagagcaagactccatctcaaaaaaaaaaaaaaaactatcaggcctagctgggtggcacatgcctgtaatcctagctgaggcggtagggtcccagaagaagaagaagaagaaaaagaagaagatatatatatatatacacacacacaaagatataaactttatatatataaagttttcattaaaaaaaaaaaaaacctctacccactttcactttaccaggttcctgggtccaacggtcttcagaggaggcagctggcaggggtcagggaggcagcgtgggacccgagggagcaggaaggcagtgtgtccccggggtgctggcagaccgatttgaactctggctatgtcttcttgcagtggccgccgccgacagcggcatcagccctcgggccgtgtggcagttccgcaaaatgatcaagtgcgtgatcccggggagtgaccccttcttggaatacaacaactacggctgctactgtggcttggggggctcaggcacccccgtggatgaactggacaagtaagtgatccgcctgcaggaaaattggagtgcctgccgggggcggggtggggcaccacgccaaggatctcacgaggcatacaaaggggacttgcatatctgctaaggataacatattttcacctcttgtcaaataaacatatatgttccaagaggaccctgtagcgaacgcaccccgttagagatggaaacattgaccgacgtgcaaaacagtgggcgatgctgccctccagtggcagaatgtagcaacattaaacatcacagcacctatccacgtgtcattttctagcagtggttgtcactgccccttctggaatacaggattttactgtattcttgcaaccatgttaaaaatcgctttcaggccaggcgcggtggctcatgcctgtaatcccagcactttgggaggccgaggcgggcggatcacttgaggtcaggagttcgagaccagcctggccaacatggtgaaaccctgtctctactaaaaaatacaaaaattagccggacatggtggcgagcgcctgtaaccccagctacttgggagactgagttggaggtttcatgagccaaggtcgtgtcactgctgtccagcctgggtaacagagcaactctgtctcaaaaaaaaaaaatgctttcaataaatatatgataaaaggacttatattttttcaagccataggatcatttctcctgaagcatcttggcgaagtcatccccacctgttcctgagagtgggcaggtgagggctgacctattgctctgcacttactcctatctcagctgtccctcccactttccaggtgctgccagacacatgacaactgctacgaccaggccaagaagctggacagctgtaaatttctgctggacaacccgtacacccacacctattcatactcgtgctctggctcggcaatcacctgtagcagtaggtttatcccttccttgacctagcccactcccaccgccagctggaaccctggggactacgacgtccctcaaaccttgcttctaggagataaaaagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgattttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattctttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatccc

SEQ ID NO: 2793 - DNA, 495 bp; single-stranded, linear
gctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaatttatcgcgcttactatggagcatttaaggatgtcaaggagaaaaacaggacctctgaagaagcagaagacctccgagccttgcgatttctatctgtgatttcaattgtggacccttggatttttatcattttcagatctccagtatttcggatattttttcacaagattttcattagacctcttaggtacaggagccggtgcagcaattccactaacatggaatccagtctgtgacagtgtttttcactctgtggtaagctgaggaatatgtcacattttcagtcaaagaacca

SEQ ID NO: 2794 - DNA, 1216 bp; single-stranded, linear
gaattctggctattttcctcctgccgttccgactcggcaccagagtctgtctctactgagaacgcagcgcgtcagggccgagctcttcactggcctgctccgcgctcttcaatgccagcgccaggcgctcaccctgcagagcgtcccgcctctcaaagaggggtgtgacccgcgagtttagataggaggttcctgccgtggggaacaccccgccgccctcggagctttttctgtggcgcagcttctccgcccgagccgcgcgcggagctgccgggggctccttagcacccgggcgccggggccctcgcccttccgcagccttcactccagccctctgctcccgcacgccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgagcgccttctccctggctttctgcgcgctacctttcatgggcttcgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaattgtgagtccccgggccccgagg

SEQ ID NO: 2795 - DNA, 2372 bp; single-stranded, linear; identical to SEQ ID NO: 2608

SEQ ID NO: 2796 - DNA, 1682 bp; single-stranded, linear
agagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggtagcaaatgctgtctccagctgctctaatgatggacagaaagggcagcctatctcattatctaatgaaataatacagacagaagcatgaaagaaaacacttaacttgcatgtgcacagcttctggtaacaaatatcgctaaaccttactgtgaatttaggcatctctggcatgccactgtttatgcattgaagtggaatttttggtataaagctaaatggtcttagaagcatagaaaatccctatgtgccaaaagtagtgaaacacaaacaaaggaaaatatattaataacagtctagtgtttttgttgagtctgccattcgtagctgaatatgtgattaattatgtgatgaaaactttttttataaatgatcttggtctattgggg

SEQ ID NO: 2797 - DNA, 1870 bp; single-stranded, linear
cccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagataatgaaagaacggagttggacattttattgcaattcctgcttccctgaatttgcatatttcttcccacctgagaaggataattatatattttaatttggattatttcttcatttttatctttttattttaatgattgttttgtcagtaatacccatggagatcaactttattattataatccatgcctctgaatattagattggtttcttggatgggattttgaatatgcatttaagaagttgggaagaatttcacagatgatgattggaggaaaagtgatgaaaagaaagacctgtgttccaggagttttctccaacttcaaacctttacgtgaatcttaaccaaagtggacatctttacatttcatgatagcttgcttttgcaatatgagtttgaaaaatcagtataagcttatgatggtgaaaagtcaacatattgagagtgataattcaattaataggatatgaacttaacgatataaaagcaaatgagggcaggagggg

SEQ ID NO: 2798 - DNA, 1682 bp; single-stranded, linear; identical to SEQ ID NO: 2796

SEQ ID NO: 2799 - DNA, 1379 bp; single-stranded, linear
agagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggaggaattttggggaaattaaaacctgcctttctgccaggatcacatcactggaagctccatgactctctttttgtaaaagaaaa

SEQ ID NO: 2800 - DNA, 2494 bp; single-stranded, linear
gtgcgcggaggggacgagcggctggaccacagccggcgcccgatcaggatctccgcgctgggatcggtggaacttgaggcagcggcggcgcggggcgccatggcacaccgagcggctccgtcttctgctcctcagagagcccggctggcggcctgggatgacaagatgtctggactgcaatcctgcacagttttgagagggagatgacttgagtggttggcttttatctccacaacaatgtccatgaacaattccaaacagctagtgtctcctgcagctgcgcttctttcaaacacaacctgccagacggaaaaccggctttccgtatttttttcagtaatcttcatgacagtgggaatcttgtcaaacagccttgccatcgccattctcatgaaggcatatcagagatttagacagaagtccaaggcatcgtttctgcttttggccagcggcctggtaatcactgatttctttggccatctcatcaatggagccatagcagtatttgtatatgcttctgataaagaatggatccgctttgaccaatcaaatgtcctttgcagtatttttggtatctgcatggtgttttctggtctgtgcccacttcttctaggcagtgtgatggccattgagcggtgtattggagtcacaaaaccaatatttcattctacgaaaattacatccaaacatgtgaaaatgatgttaagtggtgtgtgcttgtttgctgttttcatagctttgctgcccatccttggacatcgagactataaaattcaggcgtcgaggacctggtgtttctacaacacagaagacatcaaagactgggaagatagattttatcttctacttttttcttttctggggctcttagcccttggtgtttcattgttgtgcaatgcaatcacaggaattacacttttaagagttaaatttaaaagtcagcagcacagacaaggcagatctcatcatttggaaatggtaatccagctcctggcgataatgtgtgtctcctgtatttgttggagcccatttctggttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaaattaagacatgtttggcaatatttcagttagttaaatacctgtagcctaactggaaaattcaggcttcatcatgtagtttgaagatactattgtcagattcaggttttgaaatttgtcaaataaacaggataactgtacattttcaacttgtttttgccaatgggaggtagacacaataaaataatgccatgggagtcacactgaaagcaattttgagcttatctgtcttatttatgctttgagtgaatcatctgttgaggtctaatgcctctacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcacatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaactctaccatggataatgcaaacaaaccgaagctacatgccaatgataggtgcaaagaatattggcaaaaggtgctttaccttgagccattatttgtgtcagagaacaaaagaaacagaatcaatatataaattcaaagactatctgcagctagtgtgtttcttctttacacacatatacacacagacatcagaaaattctgttgagagcaggttcattaaatttgtaagatggcatattctaaagcctgtgctaccagtactaagaggggaagactggcaatttgccaagcacttggggattattataacaattaactaggagatcaagagataataatctctccccaaattttccaataataattgag

SEQ ID NO: 2801 - DNA, 1417 bp; single-stranded, linear
ggcacagacgcacgggacaggagagcctgggcaagactggagagcccagacctgggatggcggattcgtgcaggaacctcacctacgtgcggggctcggtggggccggccaccagcaccctgatgttcgtggccggtgtggtgggcaacgggctggccctgggcatcctgagcgcacggcgaccggcgcgcccctcggccttcgcggtgctggtcaccggactggcggccaccgacctgctgggcaccagcttcctgagcccggccgtgttcgtggcctatgcgcgcaacagctccctgctgggcctggcccgaggcggccccgccctgtgcgatgccttcgccttcgccatgaccttcttcggcctggcgtccatgctcatcctctttgccatggccgtggagcgctgcctggcgctgagccacccctacctctacgcgcagctggacgggccccgctgcgcccgcctggcgctgccagccatctacgccttctgcgtcctcttctgcgcgctgcccctgctgggcctgggccaacaccagcagtactgccccggcagctggtgcttcctccgcatgcgctgggcccagccgggcggcgccgccttctcgctggcctacgccggcctggtggccctgctggtggctgccatcttcctctgcaacggctcggtcaccctcagcctctgccgcatgtaccgccagcagaagcgccaccagggctctctgggtccacggccgcgcaccggagaggacgaggtggaccacctgatcctgctggccctcatgacagtggtcatggccgtgtgctccctgcctctcacgatccgctgcttcacccaggctgtcgcccctgacagcagcagtgagatgggggacctccttgccttccgcttctacgccttcaaccccatcctggacccctgggtcttcatccttttccgcaaggctgtcttccagcgactcaagctctgggtctgctgcctgtgcctcgggcctgcccacggagactcgcagacacccctttcccagctcgcctccgggaggagggacccaagggccccctctgctcctgtgggaaaggaggggagctgcgtgcctttgtcggcttggggcgaggggcaggtggagcccttgcctcccacacagcagtccagcggcagcgccgtgggaacgtcgtccaaagcagaagccagcgtcgcctgctccctctgctgacatttcaagctgaccctgtgatctctgccctgtcttcgggcgacaggagccagaaaatcagggacatggctgatggctgcggatgctggaaccttggcccccaaactctggggccgatcagctgctgtttctctgcggcagggcagtcgctgctggctctgggaagagagtgagggacagaggaaacgtttatcctggag

SEQ ID NO: 2802 - DNA, 14607 bp; single-stranded, linear
gctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaatttatcgcgcttactatggagcatttaaggatgtcaaggagaaaaacaggacctctgaagaagcagaagacctccgagccttgcgatttctatctgtgatttcaattgtggacccttggatttttatcattttcagatctccagtatttcggatattttttcacaagattttcattagacctcttaggtacaggagccggtgcagcaattccactaacatggaatccagtctgtgacagtgtttttcactctgtggtaagctgaggaatatgtcacattttcagtcaaagaaccagaattctggctattttcctcctgccgttccgactcggcaccagagtctgtctctactgagaacgcagcgcgtcagggccgagctcttcactggcctgctccgcgctcttcaatgccagcgccaggcgctcaccctgcagagcgtcccgcctctcaaagaggggtgtgacccgcgagtttagataggaggttcctgccgtggggaacaccccgccgccctcggagctttttctgtggcgcagcttctccgcccgagccgcgcgcggagctgccgggggctccttagcacccgggcgccggggccctcgcccttccgcagccttcactccagccctctgctcccgcacgccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcggcgtccactgcgcccgctgccctcggtcttctacatgctggtgtgtggcctgacggtcaccgacttgctgggcaagtgcctcctaagcccggtggtgctggctgcctacgctcagaaccggagtctgcgggtgcttgcgcccgcattggacaactcgttgtgccaagccttcgccttcttcatgtccttctttgggctctcctcgacactgcaactcctggccatggcactggagtgctggctctccctagggcaccctttcttctaccgacggcacatcaccctgcgcctgggcgcactggtggccccggtggtgagcgccttctccctggctttctgcgcgctacctttcatgggcttcgggaagttcgtgcagtactgccccggcacctggtgctttatccagatggtccacgaggagggctcgctgtcggtgctggggtactctgtgctctactccagcctcatggcgctgctggtcctcgccaccgtgctgtgcaacctcggcgccatgcgcaacctctatgcgatgcaccggcggctgcagcggcacccgcgctcctgcaccagggactgtgccgagccgcgcgcggacgggagggaagcgtcccctcagcccctggaggagctggatcacctcctgctgctggcgctgatgaccgtgctcttcactatgtgttctctgcccgtaattgtgagtccccgggccccgagggggccgccgtcggcgcgctgggtgcgggaagggggctctggatttcggtccctcccctttttcctctgagtctcggaacgctccagctctcagaccctcttcctcccaggtaaaggccgggagaggagggcgcatctcttttccaggcaccccaccatgggcaatgcctccaatgactcccagtctgaggactgcgagacgcgacagtggcttcccccaggcgaaagcccagccatcagctccgtcatgttctcggccggggtgctggggaacctcatagcactggcgctgctggcgcgccgctggcggggggacgtggggtgcagcgccggccgcaggagctccctctccttgttccacgtgctggtgaccgagctggtgttcaccgacctgctcgggacctgcctcatcagcccagtggtactggcttcgtacgcgcggaaccagaccctggtggcactggcgcccgagagccgcgcgtgcacctacttcgctttcgccatgaccttcttcagcctggccacgatgctcatgctcttcgccatggccctggagcgctacctctcgatcgggcacccctacttctaccagcgccgcgtctcggcctccgggggcctggccgtgctgcctgtcatctatgcagtctccctgctcttctgctcgctgccgctgctggactatgggcagtacgtccagtactgccccgggacctggtgcttcatccggcacgggcggaccgcttacctgcagctgtacgccaccctgctgctgcttctcattgtctcggtgctcgcctgcaacttcagtgtcattctcaacctcatccgcatgcaccgccgaagccggagaagccgctgcggaccttccctgggcagtggccggggcggccccggggcccgcaggagaggggaaagggtgtccatggcggaggagacggaccacctcattctcctggctatcatgaccatcaccttcgccgtctgctccttgcctttcacgatttttgcatatatgaatgaaacctcttcccgaaaggaaaaatgggacctccaagctcttaggtttttatcaattaattcaataattgacccttgggtctttgccatccttaggcctcctgttctgagactaatgcgttcagtcctctgttgtcggatttcattaagaacacaagatgcaacacaaacttcctgttctacacagtcagatgccagtaaacaggctgacctttgaggtcagtagtttaaaagttcttagttatatagcatctggaagatcattttgaaattgttccctggagaaatgaaaacagtgtgtaaacaaaatgaagctgccctaataaaaaggagtatacaaacatttaagctgtggtcaaggctacagatgtgctgacaaggcacttcatgtaaagtgtcagaaggagctacaaaacctaccctcaatgagcatggtacttggcctttggaggaacaatcggctgcattgaagatccagctgcctattgatttaagctttcctgttgaatgacaaagtatgtggttttgtaatttgtttgaaaccccaaacagtgactgtactttctattttaatcttgctactaccgttatacacatatagtgtacagccagaccagattaaacttcatatgtaatctctaggaagtcaatatgtggaagcaaccaagcctgctgtcttgtgatcacttagcgaaccctttatttgaacaatgaagttgaaaatcataggcaccttttactgtgatgtttgtgtatgtgggagtactctcatcactacagtattactcttacaagagtggactcagtgggttaacatcagttttgtttactcatcctccaggaactgcaggtcaagttgtcaggttatttattttataatgtccatatgctaatagtgatcaagaagactttaggaatggttctctcaacaagaaataatagaaatgtctcaaggcagttaattctcattaatactcttattatcctatttctgggggaggatgtacgtggccatgtatgaagccaaatattaggcttaaaaactgaaaaatctggttcattcttcagatatactggaacccttttaaagttgatattggggccatgagtaaaatagattttataagatgactgtgttgtaccaaaattcatctgtctatattttatttaggggaacatggtttgactcatcttatatgggaaaccatgtagcagtgagtcatatcttaatatatttctaaatgtttggcatgtaaatgtaaactcagcatcaaaatatttcagtgaatttgcactgtttaatcatagttactgtgtaaactcatctgaaatgttacaaaaataaactataaaacaagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggtagcaaatgctgtctccagctgctctaatgatggacagaaagggcagcctatctcattatctaatgaaataatacagacagaagcatgaaagaaaacacttaacttgcatgtgcacagcttctggtaacaaatatcgctaaaccttactgtgaatttaggcatctctggcatgccactgtttatgcattgaagtggaatttttggtataaagctaaatggtcttagaagcatagaaaatccctatgtgccaaaagtagtgaaacacaaacaaaggaaaatatattaataacagtctagtgtttttgttgagtctgccattcgtagctgaatatgtgattaattatgtgatgaaaactttttttataaatgatcttggtctattggggcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccagatcaggtaccacacaaacaactatgcatccagctccacctccttaccctgccagtgttcctcaaccttgatgtggagcgaccatttggaaagataatgaaagaacggagttggacattttattgcaattcctgcttccctgaatttgcatatttcttcccacctgagaaggataattatatattttaatttggattatttcttcatttttatctttttattttaatgattgttttgtcagtaatacccatggagatcaactttattattataatccatgcctctgaatattagattggtttcttggatgggattttgaatatgcatttaagaagttgggaagaatttcacagatgatgattggaggaaaagtgatgaaaagaaagacctgtgttccaggagttttctccaacttcaaacctttacgtgaatcttaaccaaagtggacatctttacatttcatgatagcttgcttttgcaatatgagtttgaaaaatcagtataagcttatgatggtgaaaagtcaacatattgagagtgataattcaattaataggatatgaacttaacgatataaaagcaaatgagggcaggaggggagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggtagcaaatgctgtctccagctgctctaatgatggacagaaagggcagcctatctcattatctaatgaaataatacagacagaagcatgaaagaaaacacttaacttgcatgtgcacagcttctggtaacaaatatcgctaaaccttactgtgaatttaggcatctctggcatgccactgtttatgcattgaagtggaatttttggtataaagctaaatggtcttagaagcatagaaaatccctatgtgccaaaagtagtgaaacacaaacaaaggaaaatatattaataacagtctagtgtttttgttgagtctgccattcgtagctgaatatgtgattaattatgtgatgaaaactttttttataaatgatcttggtctattggggagagaggaaggcgtggctccctcccgggccagtgagccctggcgccgccgcggccgcggtcccagcagcggagtagggcggcggctgcgccccgcaccatggggggcagcccagccccagccgcggtaaacgccgacctccgccgccgcccgcgccgcgtctgccccctcccgctgcggctctctggacgccatcccctcctcacctcgaagccaacatgaaggagacccggggctacggaggggatgcccccttctgcacccgcctcaaccactcctacacaggcatgtgggcgcccgagcgttccgccgaggcgcggggcaacctcacgcgccctccagggtctggcgaggattgcggatcggtgtccgtggccttcccgatcaccatgctgctcactggtttcgtgggcaacgcactggccatgctgctcgtgtcgcgcagctaccggcgccgggagagcaagcgcaagaagtccttcctgctgtgcatcggctggctggcgctcaccgacctggtcgggcagcttctcaccaccccggtcgtcatcgtcgtgtacctgtccaagcagcgttgggagcacatcgacccgtcggggcggctctgcacctttttcgggctgaccatgactgttttcgggctctcctcgttgttcatcgccagcgccatggccgtcgagcgggcgctggccatcagggcgccgcactggtatgcgagccacatgaagacgcgtgccacccgcgctgtgctgctcggcgtgtggctggccgtgctcgccttcgccctgctgccggtgctgggcgtgggccagtacaccgtccagtggcccgggacgtggtgcttcatcagcaccgggcgagggggcaacgggactagctcttcgcataactggggcaaccttttcttcgcctctgcctttgccttcctggggctcttggcgctgacagtcaccttttcctgcaacctggccaccattaaggccctggtgtcccgctgccgggccaaggccacggcatctcagtccagtgcccagtggggccgcatcacgaccgagacggccattcagcttatggggatcatgtgcgtgctgtcggtctgctggtctccgctcctgataatgatgttgaaaatgatcttcaatcagacatcagttgagcactgcaagacacacacggagaagcagaaagaatgcaacttcttcttaatagctgttcgcctggcttcactgaaccagatcttggatccttgggtttacctgctgttaagaaagatccttcttcgaaagttttgccaggaggaattttggggaaattaaaacctgcctttctgccaggatcacatcactggaagctccatgactctctttttgtaaaagaaaagtgcgcggaggggacgagcggctggaccacagccggcgcccgatcaggatctccgcgctgggatcggtggaacttgaggcagcggcggcgcggggcgccatggcacaccgagcggctccgtcttctgctcctcagagagcccggctggcggcctgggatgacaagatgtctggactgcaatcctgcacagttttgagagggagatgacttgagtggttggcttttatctccacaacaatgtccatgaacaattccaaacagctagtgtctcctgcagctgcgcttctttcaaacacaacctgccagacggaaaaccggctttccgtatttttttcagtaatcttcatgacagtgggaatcttgtcaaacagccttgccatcgccattctcatgaaggcatatcagagatttagacagaagtccaaggcatcgtttctgcttttggccagcggcctggtaatcactgatttctttggccatctcatcaatggagccatagcagtatttgtatatgcttctgataaagaatggatccgctttgaccaatcaaatgtcctttgcagtatttttggtatctgcatggtgttttctggtctgtgcccacttcttctaggcagtgtgatggccattgagcggtgtattggagtcacaaaaccaatatttcattctacgaaaattacatccaaacatgtgaaaatgatgttaagtggtgtgtgcttgtttgctgttttcatagctttgctgcccatccttggacatcgagactataaaattcaggcgtcgaggacctggtgtttctacaacacagaagacatcaaagactgggaagatagattttatcttctacttttttcttttctggggctcttagcccttggtgtttcattgttgtgcaatgcaatcacaggaattacacttttaagagttaaatttaaaagtcagcagcacagacaaggcagatctcatcatttggaaatggtaatccagctcctggcgataatgtgtgtctcctgtatttgttggagcccatttctggttacaatggccaacattggaataaatggaaatcattctctggaaacctgtgaaacaacactttttgctctccgaatggcaacatggaatcaaatcttagatccttgggtatatattcttctacgaaaggctgtccttaagaatctctataagcttgccagtcaatgctgtggagtgcatgtcatcagcttacatatttgggagcttagttccattaaaaattccttaaaggttgctgctatttctgagtcaccagttgcagagaaatcagcaagcacctagcttaataggacagtaaatctgtgtggggctagaacaaaaattaagacatgtttggcaatatttcagttagttaaatacctgtagcctaactggaaaattcaggcttcatcatgtagtttgaagatactattgtcagattcaggttttgaaatttgtcaaataaacaggataactgtacattttcaacttgtttttgccaatgggaggtagacacaataaaataatgccatgggagtcacactgaaagcaattttgagcttatctgtcttatttatgctttgagtgaatcatctgttgaggtctaatgcctctacttggcctatttgccagagaacatcttaatgcagcctgcatagtgaaatggttattttgagatcaccgctctgtagctaacccttataaactaggctcagtaaaataaagcactcttattttttgatctggcctattttgcccctcattgtgtagcctcaattaacacatgcatggtcatgacacccagaattcatgatggtttgttataacaacctctgcatattccaggtctggcagacaggttgcctgaccctgcaatcctatctagaatgggcccattcttgtcacatttgacaaataggactgcctacatttattattatgaaggtcgattgttgttggaagtgttttttcatgtcatagattagcaattttcaaataattattttttctctgaaaattttgtgtgtgattgcacaataaataatttttagagaaacaaaggctctttctcagcacattgatgggcaactagaattacagcagtttcaaactctaccatggataatgcaaacaaaccgaagctacatgccaatgataggtgcaaagaatattggcaaaaggtgctttaccttgagccattatttgtgtcagagaacaaaagaaacagaatcaatatataaattcaaagactatctgcagctagtgtgtttcttctttacacacatatacacacagacatcagaaaattctgttgagagcaggttcattaaatttgtaagatggcatattctaaagcctgtgctaccagtactaagaggggaagactggcaatttgccaagcacttggggattattataacaattaactaggagatcaagagataataatctctccccaaattttccaataataattgagggcacagacgcacgggacaggagagcctgggcaagactggagagcccagacctgggatggcggattcgtgcaggaacctcacctacgtgcggggctcggtggggccggccaccagcaccctgatgttcgtggccggtgtggtgggcaacgggctggccctgggcatcctgagcgcacggcgaccggcgcgcccctcggccttcgcggtgctggtcaccggactggcggccaccgacctgctgggcaccagcttcctgagcccggccgtgttcgtggcctatgcgcgcaacagctccctgctgggcctggcccgaggcggccccgccctgtgcgatgccttcgccttcgccatgaccttcttcggcctggcgtccatgctcatcctctttgccatggccgtggagcgctgcctggcgctgagccacccctacctctacgcgcagctggacgggccccgctgcgcccgcctggcgctgccagccatctacgccttctgcgtcctcttctgcgcgctgcccctgctgggcctgggccaacaccagcagtactgccccggcagctggtgcttcctccgcatgcgctgggcccagccgggcggcgccgccttctcgctggcctacgccggcctggtggccctgctggtggctgccatcttcctctgcaacggctcggtcaccctcagcctctgccgcatgtaccgccagcagaagcgccaccagggctctctgggtccacggccgcgcaccggagaggacgaggtggaccacctgatcctgctggccctcatgacagtggtcatggccgtgtgctccctgcctctcacgatccgctgcttcacccaggctgtcgcccctgacagcagcagtgagatgggggacctccttgccttccgcttctacgccttcaaccccatcctggacccctgggtcttcatccttttccgcaaggctgtcttccagcgactcaagctctgggtctgctgcctgtgcctcgggcctgcccacggagactcgcagacacccctttcccagctcgcctccgggaggagggacccaagggccccctctgctcctgtgggaaaggaggggagctgcgtgcctttgtcggcttggggcgaggggcaggtggagcccttgcctcccacacagcagtccagcggcagcgccgtgggaacgtcgtccaaagcagaagccagcgtcgcctgctccctctgctgacatttcaagctgaccctgtgatctctgccctgtcttcgggcgacaggagccagaaaatcagggacatggctgatggctgcggatgctggaaccttggcccccaaactctggggccgatcagctgctgtttctctgcggcagggcagtcgctgctggctctgggaagagagtgagggacagaggaaacgtttatcctggag

SEQ ID NO: 2803 - DNA, 2588 bp; single-stranded, linear
gctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacag

SEQ ID NO: 2804 - DNA, 2588 bp; single-stranded, linear; identical to SEQ ID NO: 2803

SEQ ID NO: 2805 - DNA, 3046 bp; single-stranded, linear
atcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcagg

SEQ ID NO: 2806 - DNA, 8222 bp; single-stranded, linear
gctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacaggctttctcctagggactgtgaggggcgcttctgactttggacttgagcactgcctgggacctgtgctgagagagcgctagcatgtctcagtggaatcaagtccaacagttagaaatcaagtttttggagcaggtggatcaattctatgatgacaactttcccatggaaattcggcatctgttggcccaatggattgaaaatcaagactgggaggcagcttctaacaatgaaaccatggcaacgattcttcttcaaaacttgttaatacaactggatgaacagttaggtcgtgtttccaaagagaaaaacctactcttgatacacaatctaaaaagaattaggaaggtccttcagggaaaatttcatggaaatccaatgcatgtagctgtggttatttcaaactgtttaagggaagagaggagaatattggctgcagccaacatgcctgtccaggggcctctagagaaatccttacaaagttcttcagtttcagaaagacagaggaatgtggagcacaaagtggctgccattaaaaacagtgtgcagatgacagaacaagataccaaatacttagaagatctgcaagacgaatttgactacaggtataaaacaattcagacaatggatcagagtgacaagaatagtgccatggtgaatcaggaagttttgacactgcaggaaatgcttaacagcctcgatttcaagagaaaggaggctctcagtaaaatgacccaaatcatccatgagacagacctgttaatgaacaccatgctcatagaagagctgcaagactggaagcggcggcagcaaatcgcctgcatcgggggtccactccacaatgggctcgaccagcttcagaactgctttacactattggcagaaagtcttttccaactgagaaggcaattggagaaactagaggagcaatctaccaaaatgacatatgaaggtgatcccattccaatgcaaagaactcacatgctagaaagagtcaccttcttgatctacaaccttttcaagaactcatttgtggttgagcgacagccatgtatgccaacccaccctcagaggccgttggtacttaaaaccctaattcagttcactgtaaaactaaggctactaataaaattgccagaactaaactatcaggtaaaggttaaggcatcaattgacaagaatgtttcaactctaagcaaccgaagatttgtactttgtggaactaatgtcaaagccatgtctattgaagaatcttccaatgggagtctctcagtagaatttcgacatttgcaaccaaaggaaatgaagtccagtgctggaggtaaaggaaatgagggctgtcacatggtgactgaagaacttcattccataacgtttgaaacacagatctgcctctatggcctgaccatagatttggagaccagctcattgcctgtggtgatgatttccaatgtcagtcagttacctaatgcttgggcatccatcatttggtacaacgtgtcaaccaacgattcccagaacttggttttctttaataatcctccacctgccacattgagtcaactactggaggtgatgagctggcagttttcatcgtacgttggtcgtggtcttaactcagatcaactccatatgctggcagagaagcttacagtccaatctagctacagtgatggtcacctcacctgggccaagttctgcaaggaacatttacctggtaaatcatttaccttttggacatggcttgaagcaatattggatctaattaagaaacacattcttcccctttggattgatgggtatgtcatgggctttgttagcaaagagaaggaacggctgttgctaaaggataaaatgcctggcacctttttattaagattcagtgaaagccatctcggaggaataactttcacctgggtggaccattctgaaagtggggaagtgagattccactctgtagaaccctacaataaaggccggttgtctgctctgccattcgctgacatcctgcgagactacaaagttattatggctgaaaacattcctgaaaaccctctgaagtacctatatcctgacattcccaaagacaaagccttcggtaaacactacagctctcagccttgcgaagtttcaagaccaacagaaaggggtgacaaaggttatgttccttctgtttttatccccatctcaacaatccgaagtgattcaacagagccacattctccatcagaccttcttcccatgtctccaagtgtgtatgcggtgttgagagaaaacctgagtcccacaacaattgaaactgcaatgaagtctccttattctgctgaatgacaggataaactctgacgcaccaagaaaggaagcaaatgaaaaagtttaaagactgttctttgcccaataaccacattttatttcttcagctttgtaaataccaggttctaggaaatgtttgacatctgaagctctcttcacactcccgtggcactcctcaattgggagtgttgtgactgaaatgcttgaaaccaaagcttcagataaacttgcaagataagacaactttaagaaaccagtgttaataacaatattaacagatcttatttttctttttggtggtggtggtggaaggggggaggtgctagcagggccagccttgaactcgctggacagagctacagacctatggggcctggaagtgcccgctgagaaagggagaagacagcagaggggttgccgaggcaacctccaagtcccagatcatgtctctgtggggtctggtctccaagatgcccccagaaaaagtgcagcggctctatgtcgactttccccaacacctgcggcatcttctgggtgactggctggagagccagccctgggagttcctggtcggctccgacgccttctgctgcaacttggctagtgccctactttcagacactgtccagcaccttcaggcctcggtgggagagcagggggaggggagcaccatcttgcaacacatcagcacccttgagagcatatatcagagggaccccctgaagctggtggccactttcagacaaatacttcaaggagagaaaaaagctgttatggaacagttccgccacttgccaatgcctttccactggaagcaggaagaactcaagtttaagacaggcttgcggaggctgcagcaccgagtaggggagatccaccttctccgagaagccctgcagaagggggctgaggctggccaagtgtctctgcacagcttgatagaaactcctgctaatgggactgggccaagtgaggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggtgtgaaagcctggtggacatttattcccagctacagcaggaggtaggggcggctggtggggagcttgagcccaagacccgggcatcgctgactggccggctggatgaagtcctgagaaccctcgtcaccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcagaaagcactggagaaatcatcaacaacactgtgcccttggagaacagcattcctgggaactgctgctctgccctgttcaagaacctgcttctcaagaagatcaagcggtgtgagcggaagggcactgagtctgtcacagaggagaagtgcgctgtgctcttctctgccagcttcacacttggccccggcaaactccccatccagctccaggccctgtctctgcccctggtggtcatcgtccatggcaaccaagacaacaatgccaaagccactatcctgtgggacaatgccttctctgagatggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggagatcctgctgggccgtggcttcaccttttggcagtggtttgatggtgtcctggacctcaccaaacgctgtctccggagctactggtctgaccggctgatcattggcttcatcagcaaacagtacgttactagccttcttctcaatgagcccgacggaacctttctcctccgcttcagcgactcagagattgggggcatcaccattgcccatgtcatccggggccaggatggctctccacagatagagaacatccagccattctctgccaaagacctgtccattcgctcactgggggaccgaatccgggatcttgctcagctcaaaaatctctatcccaagaagcccaaggatgaggctttccggagccactacaagcctgaacagatgggtaaggatggcaggggttatgtcccagctaccatcaagatgaccgtggaaagggaccaaccacttcctaccccagagctccagatgcctaccatggtgccttcttatgaccttggaatggcccctgattcctccatgagcatgcagcttggcccagatatggtgccccaggtgtacccaccacactctcactccatccccccgtatcaaggcctctccccagaagaatcagtcaacgtgttgtcagccttccaggagcctcacctgcagatgccccccagcctgggccagatgagcctgccctttgaccagcctcacccccagggcctgctgccgtgccagcctcaggagcatgctgtgtccagccctgaccccctgctctgctcagatgtgaccatggtggaagacagctgcctgagccagccagtgacagcgtttcctcagggcacttggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcagg

SEQ ID NO: 2807 - DNA, 11046 bp; single-stranded, linear
tttatttttaatttaatcacttaatttttaatttttaagatggagtctcactctgttgcccaggctgaagtgcaagggtgtaatctcagctcactgcagcctctgcctcccggattccagtgattttcctgcttcagcttcccaggtagctgggattgcaggcacatgccactgtgcccagataattttttgtattttttagtagagacggggcttcaccatgttggccaggctggtcttgaactcctaacctcagatgatccgcacacctcggcctcccaaagtgctaggattacaggcatgagcctctgcgcctggcctttacttcagtttcaaagagtgaaggtcaagacactgtttttttttatgttttgtttttaattttgttttaaattttttttgtagagatgggatcttgctatgttgcccaggctggtctcgaactcctggcctccagcaatcctcctgcctcagcctcccagagtattgggattacaggtgtgagccattgtgcttgatcaagatgctgttatgggctgagttgtgttcctcaaaaattctcttgaagtcctaatctcaagtacttcaggacgtgaccttattttgaaggacccccttatagggtctttacagaggtaattaagttaaaatgaggccattaggatggggcctaatgcaatatgactggtatccttgaaaaaaggggaaacttggagactgacttgcatacaaagagaacagtgtgtgaacgtgaaaatggccaaggagggaggcctggaatagagccttccttcacatccctgagaaggaatcaatcaatcctgctcaggttaaccttgatcttggacttctagcctccagcatcttgagagatttctgttgtttaagtcatgcaatatgtagtactttgttacagcagccctagcaaactgatacactcaccaaatcgattttgtgactcactattgggttgtaaccagcagtacatagacataaagttattttttccttacgctttatcttgtgcaatcgtgtgtgtgtgtgtgtgtgtgtgtgtgtgtgtgtgtgtgtgtgtgacggagtcttgttctgtcaccaggctggagtgcagtggcttgatctcggctcactataatcacagccttccagattcaagtgatttccctgcctcagcctcctgagtagctgggactacaggcgcgcaccaccacgcccgactaattttttgtatttttagtagagacggggtttcaccatgttggccaggatggtctcaatctcctgaccttgtgatctgcctgcctcagcctcccaaagtgctgggattacaggcgtgagcctctcttgtgcaatctttaccaccactcaatgggatgtcaaggtccaggggagggtgatacagtcaccctcacagtcatgcaggtgcagatgtcattaatgaaggtctgacagaccctgcaattgtacaatctgaagatgagtatctccttaaatttcatactctaggcactttaccctagcctagactctgttgaagtaggtataactattattctcatttgagggattgacacctgattgtgaacctcctaaatggagtcatacccaagccagatttgcctctaaattctgttttttccccttacatcacagtgttcccattggtatagtcagttacagagggagtaatatatactatttttctaccagtacttgctcctcgccttcctaccccctaaaaggagccaaagtcagagatcacatttactcttttccctcctcctctccaagtctttggggacttgtagctctgacacccttagatggtgaaacctggcttcacctactgtctgtggatgtctgcaggcagagtgggcactcaggagcacatacaaagcacgtgtgccgtgaacacgtatgtgcacacaccttgatcctagcatggcttgttggacaagccaatggacagagtccctgcctgccacctccacccctgctctcccttctcttccattcactgtcctgcagacacagcaaacacatacgcacatacaccctcaatatccttttggcagtaacatgacccccaaatctggggacttctatgtaggatggagacccttctcctttcctcatacctggtttattatgaaccataaaaatagtgcctgacagttactgtgtgtcaggcattgttctaagccttcagatgttttactgcattttattctcacattatgggttaagacttatttgctccattttacagatgacgagaatgaatcacagagtaaattgctcagggttgtgtggttagcagcattagcaggatttgaacccaagcagcctgtatccacagtccagtcttttaactgctatattttgctgtgttcaaaccctctgctgcctggctgggtccacacacgtgcactcatgcacagacctgcggggtagcaagggatggaggaggaggagctggttctggaaatcaattcaggcaccagggggcagcataggcctagctttggcccctcagcccagcccctgctatgggagggaggaggggagtagaaacttcctcccaccgcccctcagacaccacctcttccacacaccggggctctcaggtgtccgggagtaaaggcctctctggatcccttggtctcctccagctcctcccccagcaaaaactgcagaaccctccactagttatgttgatgactcagaagttgagcaagactgtgtgtgtgtgtgtgtgtgtgtgtgtgtgtgtgtgtgtgtgtgtgtggtgttgtgattgcaatgggctctgtttgtgagcctgcctgcacgtgtgtgtgtgtgtgtgtgtgtgtgtgtgtgtagtcttgtggtcagggaagttgtgcatgtgtgtgtttgtttcttggcgtgtctcagtgtttaccccagaaacatataggaacttggcagataggaacacagcagattcgtattcaaacttgccccttgtgaatctgcaggcagcagctccggcttgtgctggttcccaccacagtctcaggaggggtgccctgtgaggagagagcaaagaccagcttcagtccaagggactcctagagtcttccagaattctgagctgagggttcccctcccccactccctcccgtcagtggtcacgagaccgacctctaaggcgttccctgccggaagggagggggacctaggagttggctggcatcgagctccctggcggctttttagggtcctccactggagggagcgcagagtccagagggatttacttttcctgaggccctggggagcccagtcccttgtgggtccaaaccccagcccttggcagagtttgagtttgggagccaggcagttaggggtggcaaatctctgtttgatattgggtgactttctggagaaaagctgatgcttttgagggggacagagtaagtgggggtcagcctccccccaagcctggctccaaggcctggaccccagtcctgatcccccacgtgttcccccactcggcacaggaggcacacatattcaccccactttcttcctcttcctcctccagcccactttctcttctctgtgtcgtcagagctccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtgttggaaggggggaggtgctagcagggccagccttgaactcgctggacagagctacagacctatggggcctggaagtgcccgctgagaaagggagaagacagcagaggggttgccgaggtgaggggttgcctccgaggtgggtgcgggggcctctatgagtgcatgggggtggattcgtggggggagctctcgggatcctcccctggctgggtggatggtccccaangagatggtttcagctantgttggtggctggtggcactgggttttancagtttcgaactcctggaggaactgggagggtccaggcctcantactcccctcccccatgggtcacgttttcacagcctcacccctgcacccccaagggcccatggaaagtcagggaaaggaggtgaaggagtgcccctctgccctgagtcgggggaagtggccgcccctccctggaaggttgatcgcagagggcagtggatccttgttaaacccctatcctgccctccactaaaggttcctgttcaagggtgtggctggggcgtgagcaagccccagatgtagacctcatggtggcccagacgagggggaatttccccctcaaaactgctccacgcttggctcgtgtagacgctgagatttcccagcggcggcgccgaattaaccctcctcgtgctgaactggctccacctccccgccttgcccccaccgccacattcacgcattgggcaactcagagaagatgttttaactttcgatcctgtggtccacaatgagaggactcgggcagataggggttgagataagcgagtttaggccaccaagcgggcggacgaggatcccagaccttgcgcttcccttctgagtttgggaggtaacactggccccgcccctcacgccgtggctcctccctcccttccccttcaaggggctgaagacaaaaggtgcccctgtcctggtcaagccaatcgacccagccttgttatgggttggggtggggaaaaatgagtcctcctgatggctggggaagaagaggggttggatatttctagccagggccatgccaggaggctggtcactctgcaaggggatgcagaggaaagcggagcccactcactccagaggacctttctcttcttgggctagagaaaggcctattggaggaacctgagcaggaggggtaaggattctgccttgaggagaaaagagctggggtaagtgggcactggaggaaagaggggcatgaaggtcttggagcagaaacgtccagagaagggacctctccattttccatccctctgagaggcctgggagaggtgagaggctgaacgtgcaacaggaggacttggggttactgggtttggggagacctggggagttgtcatcccatcctctccctcatctctgggagagggatattatgagaaacgtgaactgagaggcccctgggaaaccactggttacccagtcctccctgaacctggaaatggggatgcaaccccctcttctacttccctgtcccctcctctcctttctacctgttttcgtctctcatctttgccttctagccctccagcttcctctctcttctaggctctttcctcctagcttactaaacccgccttttttccagtctcttccatcctcttccttagttctctctactttccttttccacctctcctccttcaagtctcctcccaccttcccccacttcttaggatgatcagatttgcccctggaagggatcctaacaacacagtgcgatggttaatccccactcagattcaaagcctgctttccaaactcacttactgagtggccttgggcagagtagagaaactccttaagcctcagtttcttcatctataaaatgggatattatatattttaaaaagtgtcgtgaggcctgaaggagataatacactgagtgtaatgcctcatacacagtaagtgcttaacaaatagtagctgttattactctcccatcctcttcatcatctagccttgtggttttcatttttattttatttcatttatttatttatttattttgagcagagtctctctctgtcgcccaggctggagtgcagtggctcgatctctgctcactgcaagctccgccccccaggttcacgccattctgtcacctcagcctccccagtagctgggagtacaggcgctcgccaccacgccctgctaattttgtttttgtatttttagtagagatggggtttcactgtgttagccaggatggtcttgatctcctgacctcgtgatctgcccgcctcggcctcccaaagcgctgggattacaggcatgagccactgcgcctggccgagccttgtggttttcaaattatctcatggagtcctagaattttgagaggtttgtctagggatgcctttggcgtcaggaggtggggagagggaagtagaagcagtcgagtttcaggctttccatgcttgctttcaacagggcatcttcggtttcgtaccttttatgtaattgagattccacagattaaaagctgacattgcctaccgctttaaaaagtttggaaagttttccactcatctaacactcatattttatagatgagaagatcgaagcccacaaagggaaggctctttgcccacagaaccagagccaggtctagagctgcaactaaatcctctgccactctaagagagctctcgctctactgccctgtctccctttgcctccccatccctctggctacagctcagctcttcccacccctgtgtctatcactgaaggagttacccccatctcaggcattgactcaggatgcccctggtttaaggtggtctggccatgagtggtggtggggacggtccctaggagggctatctatgggaggtcccctggctgccccaggagataggccaagtttctttgggcacccctcagagtggccttatttttttcctccaggcaacctccaagtcccagatcatgtctctgtggggtctggtctccaagatgcccccagaaaaagtgcagcggctctatgtcgactttccccaacacctgcggcatcttctgggtgactggctggagagccagccctggtgagtcctggctgctccctgctggtcccccaagtcttccctaactcatcttccttctccttagatttttctcccctcacccatggattcagaacttgagacctgttattccatgtgtagtgacctagatttagcagggagtctgtgccccatcaagaccaggctatgaatgttgacagatggagacccccatctcttaggaggctgagccgaagaggaggggggtttgggctgggacaaaggcacttctcataacagctagaagactgggaaacaaggcgcatgggtgaaagctacagagggcctagatggagaataaggagcgagaaaggaatgctgacttttggctgtggggtaaaggtcaggaaactgaagaagcctggcctgaagtacctctcctgatcttcctgcaagggagttcctggtcggctccgacgccttctgctgcaacttggctagtgccctactttcagacactgtccagcaccttcaggcctcggtgggagagcagggggaggggagcaccatcttgcaacacatcagcacccttgaggtggggcaggaggggaggggacaaggctgggtggggctgaggttgaactgggttgagcattgggccctggaagaaaattggttggatgctggaagcaaattggtgttcctgtggttaactgctagctagcaggcaaattagattttaaaagcatgcaaatgcacaaaaacttctggagtctacagttgtgcttccttatagtatatgtgtgaatgcaggcctggggattggagggattgaaggacatgggtaagagcaaagctcactgtttaccaccctcatttctgtagagcatatatcagagggaccccctgaagctggtggccactttcagacaaatacttcaaggagagaaaaaagctgttatggaacaggtattgtgatattccacctcccaccccaactcaatcccctgagactttggcctgagccatgacaaactagaaagaatttgatcctcagaaaaggctcagtgttctaggcccaggaatgaccaaaggaggttcctagggtcagagtgaaccccaagtcaagctcagggaatctttctatgagggactgaaggtaagaggccggggagaacagagcaagggataaggagctgattctgctaggagcaaggtcttatctccacgatattccaaaaggtcaggaagaactgccaaaggggagaggggaacaagaaaacgctatatgcagagcagagagtggaggccaggtatagagggatgagcagagtgtttgagttcttggcatctgtccttcctgtgtagttccgccacttgccaatgcctttccactggaagcaggaagaactcaagtttaagacaggcttgcggaggctgcagcaccgagtaggggagatccaccttctccgacaagccctgcagaagggggctgaggctggccaaggtgggggccagggtggttctggggagtgtgtaagagtggttgcctcttggatctcaaccttatctgaacctctaatctgtctgcacccttgatttctgcccccaaccctcagtgtctctgcacagcttgatagaaactcctgctaatgggactgggccaagtgaggtgagtaatgggctgacaggtggagaccttggtcaaagtgcagctggagggatggaagctagacctcagaaagacacaggctgaagtagggcaagggaatgccagaggagtgagaaaaagaccgtatcccaggagctgggtgtggaggcagcgtgaggccctggctcaggcccctctctgcccataggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggttgggctagggctgatggggaagagggggcaagctgggggtgggcagctgaccctgctgaaggccctacaggtgagagaaagaagccaggcgggagggccttggcagtggaccaagatgcataaaagccagttccagcggggctgtgcacactgtcgttcaggtcgcatcctgtacaagtgggcctagtggaggggcacaagcggggactcatccaacccaggcttctctcctcaagccccatgcctagaggaataggagggcttttccatttggtttattgggtgggaacacttcccaatttgccacaaagcactgtaagtggtggcagttgttcttgggtgcaagaaccgtcggggagaggcagctgggtttccacagggggtgtaggcaactgataatgaacctcccacccacaccctaggccaacagatcacagaaccccttcagcccaggtgccttgcagccacacccactacccaccccacttctccacacatgatagcctttctccctgggtataggggaagggggtctgggccggagcaagcagccttaatcctgtgccccctgaccactgtcctggccccaggtgtgaaagcctggtggacatttattcccagctacagcaggaggtaggggcggctggtggggagcttgagcccaagacccgggcatcgctgactggccggctggatgaagtcctgagaaccctcgtcaccaggtattccccgggagctcccagtctggcctagaacagacctcgggaagaaaagaagggggctagagctgtggggagggcaccagcagggacctagcccccaactccccttgtgtcctcctcactcccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcgtaagctgggattggacctggggttggagaagggctgttagggtgatggaggcagcctggagggctggcactgaaaagagcaagggatggggagggagggccatgggatgtggagaccctgaatggtcaaggcagaggaaagggagggacccatttagggctggaatggggtgggggcatcatgatttggccaagatggggactcctcccttaagaacccaaacagagacatggagatttagggctggtgacagtgggtagtctacactcacccatgcactcgccacacctgacgacagtgagatgagctcgttcacactctgacctcccctgggcagagaaagcactggagaaatcatcaacaacactgtgcccttggagaacagcattcctgggaactgctgctctgccctgttcaagaacctggtgaggggctttggggtgcagtgaggggggcaccactaggagactgtgggactctccttggagaggatgtcaggaagcccaggaggagcggtctctgtcctcatgacctcgcccttgctctccctcaccccacccacagcttctcaagaagatcaagcggtgtgagcggaagggcactgagtctgtcacagaggagaagtgcgctgtgctcttctctgccagcttcacacttggccccggcaaactccccatccagctccaggtgaaccgtggcccagccctgccccaatctgggaccccgagtcctcctccaatgccacgcacaagggccctggaccctcacctcttgtgactgccccataccccatgtgtctgggattcatgcacactggggcccgggtgagtgggggtgagcaagagcatggagtgcacagggcagggaatggtagtggatagcagcaaacacttcggaagcacttcctatagaccaggggcactctattaaatgatacatactgcacatgcgtgccagcacacacacgtctggttttcacaataacattatgaggtaggcagtattatcagcctcattttatagcatgaggacattgagacagagagtttaagtagtttgtcccagtcacccagctaagtgttggagctggtatctgaaacctggaagtctggttccatagcgattatagtaaccacttctctacggtgaggccctgattgagcttcaaaacgcatttaataacatgg

SEQ ID NO: 2808 - DNA, 690 bp; single-stranded, linear
ggaaagaaagaaagaaaagaaaccctgtcctcaccctacttcaggccctgtctctgcccctggtggtcatcgtccatggcaaccaagacaacaatgccaaagccactatcctgtgggacaatgccttctctgagatggtgaggaaagtccttggtagttggagggaacagggtgcagggtgggttctaacatgggcagtggtgcaggcctgctgatggggtggtgggcatgtcggatgggtgtgaccttaacacttcttcatgggcctgctttcgtgcttctgacctcttttcaccccagtcttaacaactatcaggccacagcactgtaacctagaaaaaacagcatgtttgtgagcgatatcaggggctgtggaggggtaggccacaggcatgtgggacggatgaaggccggcccgaggaataacaagacggtagcctgcagtgctctcttcttcccccttctccccaggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggttcagttctcc

SEQ ID NO: 2809 - DNA, 666 bp; single-stranded, linear
gcggccgcgagctctaatacgactcactatagggcgtcgactcgatcataccactgcactcaagcctgggtgacagagcaagactctgtctcaaaaaaaaaaaaaaaaaaaggccaggcatggtggttcatgcctgtaatcccagcactttgggaggccgagacggatagatcacctgaggtcaggagttcgagaccagcctggccaacatggcaaaaccccgtctctactaaaaacaaaaaaatagccaggatggtcgtttgcgtctgtaatcccagctactcggctgaggcaggaggtgaacccaggaggtaaaggctgcaggggaagatgaaaccattgcactccagcctgggcaagactctgtatcaaaaaaaaaaaaaaaaaggctaggtgtggtggctcacacctgtaatcccagcactttgggaggctgaggcgggcggatcacaaggtcaagaaatcgagaccatcctgaccaacatggtgaaaccccgtctctactaaaaatacaaaaattacctgggcatggtggcgcatgcctgtattcccaactactcgggaggctgaggcatgaaaatcacttgaacctgggaggcagaggttgcaggcgagccaagattgtgccactgcactccagcctgccaacaaaaatgagattctgtc

SEQ ID NO: 2810 - DNA, 5424 bp; single-stranded, linear
ggttaccttccctttgggcgtcaacttctgccacacctccttagggagagggtgtagcatagtagttaagaggggtccagggccagaatgcctgggtttaaatcctagctctgcctcttaccagctatgtagacctgggcaagtcattcgacgtttttggacttccatttcttcatctgtaagatggaattattataatccctacttccatagcctggtaaagagcaaataaatatatggaaaggcttgaaatagtggctggcacgtgtaagcattaggattggtcgttgtcattgatggagtctcaggttcggtctgatcctcagcccctgtgattctgtcgtgagggcactcacagctcactgcctgccctaaacaggctccagctctggccctccctcggctcacacctttccccctctccccctaggagatcctgctgggccgtggcttcaccttttggcagtggtttgatggtgtcctggacctcaccaaacgctgtctccggagctactggtctgaccggtgagtccccaccctgggtagtttgagcagccatacaccagtcacctccatactcactgcccatgccccatcctctccttcatcccggccaggctgatcattggcttcatcagcaaacagtacgttactagccttcttctcaatgagcccgacggaacctttctcctccgcttcagcgactcagagattgggggcatcaccattgcccatgtcatccggggccaggatggtgaggccaccccagccagtcctctgtctctgtgcctgtgccctctggggtttcttctgggaatgaaatgtcctgaccttcctgatgccgatcctgatcttcaggaagttcttccagcttctcttcttccttctgtggtctaaatgttcaccttctcactgtgagctctgtgggaacggagactagtgggtctctctccctcaggagccccaccctaggtcctctctcccttgccttggtggagtgagaacaggtcttatggtaggggttggggaaggggaagaaatccggacagagggatctcagggtctccttcctaccataggctctccacagatagagaacatccagccattctctgccaaagacctgtccattcgctcactgggggaccgaatccgggatcttgctcagctcaaaaatctctatcccaagaagcccaaggatgaggctttccggagccactacaagcgtgagctggaactggcagctctgattccttcctgtcacccacttcctgccatgctccccgctgccatcctctccccagcccgtgagttatcctgaggtcactccgaatttccatagctgtgcttttcttacttcccggatgatccatgcccaccttttccacctcccttcctccctaacccgagagcaatccatggcagtcttttccatctcacaacagctgaacagctgaacagatgggtaaggatggcaggggttatgtcccagctaccatcaagatgaccgtggaaaggtgagtgtggtggtatggacagtgggtaggtcaggggcttagtgcttatctgcaggaaggaggggtggcatcaacccttggtcagtcacatgtacctccttccctcctccagggaccaaccacttcctaccccagagctccagatgcctaccatggtgccttcttatgaccttggaatggcccctgattcctccatgagcatgcagcttggcccagatatggtgtaaggagctggaaagacaggaatgggagtggtctgtgcagatgggctaatcttagcatgggcagctgggagagctggcactgggggctgaacagggaatcttcctttccatgagagggacacctgttcaaaagcagggtgtggtggtgtccaggagaagggctggcatcagggggtctgttttctttccccaggccccaggtgtacccaccacactctcactccatccccccgtatcaaggcctctccccagaagaatcagtcaacgtgttgtcagccttccaggagtaagtgaaaaacctcatggggataccatcccactctaagggggtgggcatttgaattgttagaagaggctcttctgtgagaaaggagcagcaaatgctaacagcctgtcttcttctcttctgtccactctaatgagggggtagtagttaagatctggactgcctaggtttgaattctagctccaccacttactggtttggggcaaattacttagcctttggtgccttatctgcacaatgggggataataatgctaataataataacctacctcactgcattattgtggagattaaatgagttcataacacttaaaaagctcgagcatagtgcatggctcatagcaaaagctgtgtaagtccagtcgtggatcacttaatgaaggagcattttctgtctttggcagtttcataattatgcggaataccattgagtataattacacaaacctagatggtatagactactatacactgaggctatattgtgtagcctattgatcctagctttaaacccgagcagcatgatactgttctgaatagtataaggaaatagtaacataatggtaaatatttgtgtgataggaattttcagcttgattataattttttttttttgagacagggtctcactcactggagtgcagtggtgcgatcttagctcccctgcaacctccgcctcttgggctcgagcaatcctcctgctgtagtgcaccacgacactcggctaattcttttttaagatttttctgcagacaaggtctcacttactgcccaagctggtctcaaactcctgggcttaagtgatcctcccacctcggcctcccaaagcgttaggattacaggcgtgagtcactctgcctggccttgattataatcttatgggaccactgtggtctgtagttgacagaaatgtcgttaatgtggtgcatgactgttattattattttctgtcctgcccctgagagccactgtcacttctctgctgtattggtttttgtttactcatctgttttggccttgaaatggcctagacatttttcttcccgaagtatgacactcgggtgcttattaacttagtcaagacacaacatctcccttcccagaaagtgaggcgggagtgaggacttggggacttaagaactaccaaagttcagagtccaaaggaaacattagaaattgggtaatccacccccataacacgcacattttacagatgagaagactgagctcagagcatagaaatagcttgcccaggccatgactaagtcaggataaggagctggagcttgtttcctcactcagtggtcctgactttgcaccactctgcatttgcctagcctgccttcctctaactgtgctctccctacttccaggcctcacctgcagatgccccccagcctgggccagatgaacctgccctttgaccagcctcacccccaggtgaatgacaaaagcccctcctgacccatgtgcctcttctttcctgggccttgcccgctctccttatttccattgctggttcctggcagggcctgctgccgtgccagcctcaggagcatgctgtgtccagccctgaccccctgctctgctcagatgtgaccatggtggaagacagctgcctgagccagccagtgacagcgtttcctcagggcacttggtgagtggcagcttgggagtggaggctgggtggcatctaggggagtgggcgccatgcctactccactgcttctcccatctccttgcaggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctgaagggaccctgggtgggagcataggaggagtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaagacgctctaactgctcagataggtgctgcggtccagcccccagctggaggagaccctgagtccaacccaggcctcccgagggggccagtgaagggatcccacacccaccgcccctatgtagggcagggaagaaattgcaaaggacttgggggatagatgggaatgggagggcaaactgcagcacttgttaaattaattaaagaaacaaaccagaagcacaaaaacggggaaggagaagggagaaggagcaggtccagtgttccaggccccaattctgggggcaaatgtgcca

SEQ ID NO: 2811 - DNA, 1475 bp; single-stranded, linear
gcagcacctatctgagcagttagagcgtctttcttttcagattgtgtacagtagattatttattttgttattttggaataaaatttattttatggcttaggatctatgacccctgccttgagagggagaatgggataggggagtgaagggaagctggcggtggatggggcaacagaaaagatgcagcaggcagggccctctcatacactggagggccacatggccaggcctggacccagactctcaccctggctcccaggcagcattggaggtgtggagccatacgtagatgtcacagccacttggacccacttgggcacagtcagactccaaattcagagtatttgggggttagcatatgtcagagaggccagcacacttgctgctgtcttctgtgcagtgtctcaccctcccaaatttgtgttgtcacgtaggcaaaagcagatagacacatgttctatgtggtcatgcaactaaggtgccagctatacatttaacatatcctaggtacatacacgttcacacagctatacacgaagaatctcagcccttgtacttttgcatagtctcatacacgtatcagaagcctccacctggctaacaggaatttggggctttgggagattttttaatcagggcaaaacctgtactagtaaccacatgtccagacccctcctatgctcccacccagggtcccttgagctgcttcccattcccctagggctgagacccaatatcctctatccctggcctctagtgtaaatgtgtctgtatgttcctgcctatccgtcctaggccctgggtcagaatgggcggagaagccttccatgccctaacctgtgctcttacccagcccccctcctgctcagccccatcaccctcagagagctctgtatgtgtgtgtgcgtgcgtgtgcgcgctgcaggtgcaggcatgttggggtgtgtctcagagcctgaacttcccttccagtcagtactggaaggaggtgggcaggggaatgatagaaaggaaggagtggattggctccacccactgtgcattctcctgttagtcttttcctcctgacccaggagtaggtggggataggagggcaccctccccatctgctgcttggcagggcatgagcaagtgtccagagcaggtctgtgggggtagtagaagagctgtctctttgggttctccctccagctgggatcaccaactggggttggcccttaggtccatgtgggacattgagatcccagattgcccatagtgggagggctgcaggaggggctgtgcccccaaggaccctccccccgactccccttgcccctccaggagaagcttagtgaggtcctgttcagtgggaggcagcagaggagggaatatgtcttcaccaatcctgcaaggagatgggagaagcagtggagtaggcatggcgcccactcccctagatgccacccagcctccactcccaagctgccactcac

SEQ ID NO: 2812 - DNA, 19301 bp; single-stranded, linear
tttatttttaatttaatcacttaatttttaatttttaagatggagtctcactctgttgcccaggctgaagtgcaagggtgtaatctcagctcactgcagcctctgcctcccggattccagtgattttcctgcttcagcttcccaggtagctgggattgcaggcacatgccactgtgcccagataattttttgtattttttagtagagacggggcttcaccatgttggccaggctggtcttgaactcctaacctcagatgatccgcacacctcggcctcccaaagtgctaggattacaggcatgagcctctgcgcctggcctttacttcagtttcaaagagtgaaggtcaagacactgtttttttttatgttttgtttttaattttgttttaaattttttttgtagagatgggatcttgctatgttgcccaggctggtctcgaactcctggcctccagcaatcctcctgcctcagcctcccagagtattgggattacaggtgtgagccattgtgcttgatcaagatgctgttatgggctgagttgtgttcctcaaaaattctcttgaagtcctaatctcaagtacttcaggacgtgaccttattttgaaggacccccttatagggtctttacagaggtaattaagttaaaatgaggccattaggatggggcctaatgcaatatgactggtatccttgaaaaaaggggaaacttggagactgacttgcatacaaagagaacagtgtgtgaacgtgaaaatggccaaggagggaggcctggaatagagccttccttcacatccctgagaaggaatcaatcaatcctgctcaggttaaccttgatcttggacttctagcctccagcatcttgagagatttctgttgtttaagtcatgcaatatgtagtactttgttacagcagccctagcaaactgatacactcaccaaatcgattttgtgactcactattgggttgtaaccagcagtacatagacataaagttattttttccttacgctttatcttgtgcaatcgtgtgtgtgtgtgtgtgtgtgtgtgtgtgtgtgtgtgtgtgtgtgacggagtcttgttctgtcaccaggctggagtgcagtggcttgatctcggctcactataatcacagccttccagattcaagtgatttccctgcctcagcctcctgagtagctgggactacaggcgcgcaccaccacgcccgactaattttttgtatttttagtagagacggggtttcaccatgttggccaggatggtctcaatctcctgaccttgtgatctgcctgcctcagcctcccaaagtgctgggattacaggcgtgagcctctcttgtgcaatctttaccaccactcaatgggatgtcaaggtccaggggagggtgatacagtcaccctcacagtcatgcaggtgcagatgtcattaatgaaggtctgacagaccctgcaattgtacaatctgaagatgagtatctccttaaatttcatactctaggcactttaccctagcctagactctgttgaagtaggtataactattattctcatttgagggattgacacctgattgtgaacctcctaaatggagtcatacccaagccagatttgcctctaaattctgttttttccccttacatcacagtgttcccattggtatagtcagttacagagggagtaatatatactatttttctaccagtacttgctcctcgccttcctaccccctaaaaggagccaaagtcagagatcacatttactcttttccctcctcctctccaagtctttggggacttgtagctctgacacccttagatggtgaaacctggcttcacctactgtctgtggatgtctgcaggcagagtgggcactcaggagcacatacaaagcacgtgtgccgtgaacacgtatgtgcacacaccttgatcctagcatggcttgttggacaagccaatggacagagtccctgcctgccacctccacccctgctctcccttctcttccattcactgtcctgcagacacagcaaacacatacgcacatacaccctcaatatccttttggcagtaacatgacccccaaatctggggacttctatgtaggatggagacccttctcctttcctcatacctggtttattatgaaccataaaaatagtgcctgacagttactgtgtgtcaggcattgttctaagccttcagatgttttactgcattttattctcacattatgggttaagacttatttgctccattttacagatgacgagaatgaatcacagagtaaattgctcagggttgtgtggttagcagcattagcaggatttgaacccaagcagcctgtatccacagtccagtcttttaactgctatattttgctgtgttcaaaccctctgctgcctggctgggtccacacacgtgcactcatgcacagacctgcggggtagcaagggatggaggaggaggagctggttctggaaatcaattcaggcaccagggggcagcataggcctagctttggcccctcagcccagcccctgctatgggagggaggaggggagtagaaacttcctcccaccgcccctcagacaccacctcttccacacaccggggctctcaggtgtccgggagtaaaggcctctctggatcccttggtctcctccagctcctcccccagcaaaaactgcagaaccctccactagttatgttgatgactcagaagttgagcaagactgtgtgtgtgtgtgtgtgtgtgtgtgtgtgtgtgtgtgtgtgtgtgtggtgttgtgattgcaatgggctctgtttgtgagcctgcctgcacgtgtgtgtgtgtgtgtgtgtgtgtgtgtgtgtagtcttgtggtcagggaagttgtgcatgtgtgtgtttgtttcttggcgtgtctcagtgtttaccccagaaacatataggaacttggcagataggaacacagcagattcgtattcaaacttgccccttgtgaatctgcaggcagcagctccggcttgtgctggttcccaccacagtctcaggaggggtgccctgtgaggagagagcaaagaccagcttcagtccaagggactcctagagtcttccagaattctgagctgagggttcccctcccccactccctcccgtcagtggtcacgagaccgacctctaaggcgttccctgccggaagggagggggacctaggagttggctggcatcgagctccctggcggctttttagggtcctccactggagggagcgcagagtccagagggatttacttttcctgaggccctggggagcccagtcccttgtgggtccaaaccccagcccttggcagagtttgagtttgggagccaggcagttaggggtggcaaatctctgtttgatattgggtgactttctggagaaaagctgatgcttttgagggggacagagtaagtgggggtcagcctccccccaagcctggctccaaggcctggaccccagtcctgatcccccacgtgttcccccactcggcacaggaggcacacatattcaccccactttcttcctcttcctcctccagcccactttctcttctctgtgtcgtcagagctccagggagggacctgggtagaaggagaagccggaaacagcgggctggggcagccactgcttacactgaagagggaggacgggagaggagtgtgtgtgtgtgtgtgtgtgtgtgtgtgtatgtatgtgtgtgctttatcttatttttctttttggtggtggtgttggaaggggggaggtgctagcagggccagccttgaactcgctggacagagctacagacctatggggcctggaagtgcccgctgagaaagggagaagacagcagaggggttgccgaggtgaggggttgcctccgaggtgggtgcgggggcctctatgagtgcatgggggtggattcgtggggggagctctcgggatcctcccctggctgggtggatggtccccaangagatggtttcagctantgttggtggctggtggcactgggttttancagtttcgaactcctggaggaactgggagggtccaggcctcantactcccctcccccatgggtcacgttttcacagcctcacccctgcacccccaagggcccatggaaagtcagggaaaggaggtgaaggagtgcccctctgccctgagtcgggggaagtggccgcccctccctggaaggttgatcgcagagggcagtggatccttgttaaacccctatcctgccctccactaaaggttcctgttcaagggtgtggctggggcgtgagcaagccccagatgtagacctcatggtggcccagacgagggggaatttccccctcaaaactgctccacgcttggctcgtgtagacgctgagatttcccagcggcggcgccgaattaaccctcctcgtgctgaactggctccacctccccgccttgcccccaccgccacattcacgcattgggcaactcagagaagatgttttaactttcgatcctgtggtccacaatgagaggactcgggcagataggggttgagataagcgagtttaggccaccaagcgggcggacgaggatcccagaccttgcgcttcccttctgagtttgggaggtaacactggccccgcccctcacgccgtggctcctccctcccttccccttcaaggggctgaagacaaaaggtgcccctgtcctggtcaagccaatcgacccagccttgttatgggttggggtggggaaaaatgagtcctcctgatggctggggaagaagaggggttggatatttctagccagggccatgccaggaggctggtcactctgcaaggggatgcagaggaaagcggagcccactcactccagaggacctttctcttcttgggctagagaaaggcctattggaggaacctgagcaggaggggtaaggattctgccttgaggagaaaagagctggggtaagtgggcactggaggaaagaggggcatgaaggtcttggagcagaaacgtccagagaagggacctctccattttccatccctctgagaggcctgggagaggtgagaggctgaacgtgcaacaggaggacttggggttactgggtttggggagacctggggagttgtcatcccatcctctccctcatctctgggagagggatattatgagaaacgtgaactgagaggcccctgggaaaccactggttacccagtcctccctgaacctggaaatggggatgcaaccccctcttctacttccctgtcccctcctctcctttctacctgttttcgtctctcatctttgccttctagccctccagcttcctctctcttctaggctctttcctcctagcttactaaacccgccttttttccagtctcttccatcctcttccttagttctctctactttccttttccacctctcctccttcaagtctcctcccaccttcccccacttcttaggatgatcagatttgcccctggaagggatcctaacaacacagtgcgatggttaatccccactcagattcaaagcctgctttccaaactcacttactgagtggccttgggcagagtagagaaactccttaagcctcagtttcttcatctataaaatgggatattatatattttaaaaagtgtcgtgaggcctgaaggagataatacactgagtgtaatgcctcatacacagtaagtgcttaacaaatagtagctgttattactctcccatcctcttcatcatctagccttgtggttttcatttttattttatttcatttatttatttatttattttgagcagagtctctctctgtcgcccaggctggagtgcagtggctcgatctctgctcactgcaagctccgccccccaggttcacgccattctgtcacctcagcctccccagtagctgggagtacaggcgctcgccaccacgccctgctaattttgtttttgtatttttagtagagatggggtttcactgtgttagccaggatggtcttgatctcctgacctcgtgatctgcccgcctcggcctcccaaagcgctgggattacaggcatgagccactgcgcctggccgagccttgtggttttcaaattatctcatggagtcctagaattttgagaggtttgtctagggatgcctttggcgtcaggaggtggggagagggaagtagaagcagtcgagtttcaggctttccatgcttgctttcaacagggcatcttcggtttcgtaccttttatgtaattgagattccacagattaaaagctgacattgcctaccgctttaaaaagtttggaaagttttccactcatctaacactcatattttatagatgagaagatcgaagcccacaaagggaaggctctttgcccacagaaccagagccaggtctagagctgcaactaaatcctctgccactctaagagagctctcgctctactgccctgtctccctttgcctccccatccctctggctacagctcagctcttcccacccctgtgtctatcactgaaggagttacccccatctcaggcattgactcaggatgcccctggtttaaggtggtctggccatgagtggtggtggggacggtccctaggagggctatctatgggaggtcccctggctgccccaggagataggccaagtttctttgggcacccctcagagtggccttatttttttcctccaggcaacctccaagtcccagatcatgtctctgtggggtctggtctccaagatgcccccagaaaaagtgcagcggctctatgtcgactttccccaacacctgcggcatcttctgggtgactggctggagagccagccctggtgagtcctggctgctccctgctggtcccccaagtcttccctaactcatcttccttctccttagatttttctcccctcacccatggattcagaacttgagacctgttattccatgtgtagtgacctagatttagcagggagtctgtgccccatcaagaccaggctatgaatgttgacagatggagacccccatctcttaggaggctgagccgaagaggaggggggtttgggctgggacaaaggcacttctcataacagctagaagactgggaaacaaggcgcatgggtgaaagctacagagggcctagatggagaataaggagcgagaaaggaatgctgacttttggctgtggggtaaaggtcaggaaactgaagaagcctggcctgaagtacctctcctgatcttcctgcaagggagttcctggtcggctccgacgccttctgctgcaacttggctagtgccctactttcagacactgtccagcaccttcaggcctcggtgggagagcagggggaggggagcaccatcttgcaacacatcagcacccttgaggtggggcaggaggggaggggacaaggctgggtggggctgaggttgaactgggttgagcattgggccctggaagaaaattggttggatgctggaagcaaattggtgttcctgtggttaactgctagctagcaggcaaattagattttaaaagcatgcaaatgcacaaaaacttctggagtctacagttgtgcttccttatagtatatgtgtgaatgcaggcctggggattggagggattgaaggacatgggtaagagcaaagctcactgtttaccaccctcatttctgtagagcatatatcagagggaccccctgaagctggtggccactttcagacaaatacttcaaggagagaaaaaagctgttatggaacaggtattgtgatattccacctcccaccccaactcaatcccctgagactttggcctgagccatgacaaactagaaagaatttgatcctcagaaaaggctcagtgttctaggcccaggaatgaccaaaggaggttcctagggtcagagtgaaccccaagtcaagctcagggaatctttctatgagggactgaaggtaagaggccggggagaacagagcaagggataaggagctgattctgctaggagcaaggtcttatctccacgatattccaaaaggtcaggaagaactgccaaaggggagaggggaacaagaaaacgctatatgcagagcagagagtggaggccaggtatagagggatgagcagagtgtttgagttcttggcatctgtccttcctgtgtagttccgccacttgccaatgcctttccactggaagcaggaagaactcaagtttaagacaggcttgcggaggctgcagcaccgagtaggggagatccaccttctccgacaagccctgcagaagggggctgaggctggccaaggtgggggccagggtggttctggggagtgtgtaagagtggttgcctcttggatctcaaccttatctgaacctctaatctgtctgcacccttgatttctgcccccaaccctcagtgtctctgcacagcttgatagaaactcctgctaatgggactgggccaagtgaggtgagtaatgggctgacaggtggagaccttggtcaaagtgcagctggagggatggaagctagacctcagaaagacacaggctgaagtagggcaagggaatgccagaggagtgagaaaaagaccgtatcccaggagctgggtgtggaggcagcgtgaggccctggctcaggcccctctctgcccataggccctggccatgctactgcaggagaccactggagagctagaggcagccaaagccctagtgctgaagaggatccagatttggaaacggcagcagcagctggcagggaatggcgcaccgtttgaggagagcctggccccactccaggagaggttgggctagggctgatggggaagagggggcaagctgggggtgggcagctgaccctgctgaaggccctacaggtgagagaaagaagccaggcgggagggccttggcagtggaccaagatgcataaaagccagttccagcggggctgtgcacactgtcgttcaggtcgcatcctgtacaagtgggcctagtggaggggcacaagcggggactcatccaacccaggcttctctcctcaagccccatgcctagaggaataggagggcttttccatttggtttattgggtgggaacacttcccaatttgccacaaagcactgtaagtggtggcagttgttcttgggtgcaagaaccgtcggggagaggcagctgggtttccacagggggtgtaggcaactgataatgaacctcccacccacaccctaggccaacagatcacagaaccccttcagcccaggtgccttgcagccacacccactacccaccccacttctccacacatgatagcctttctccctgggtataggggaagggggtctgggccggagcaagcagccttaatcctgtgccccctgaccactgtcctggccccaggtgtgaaagcctggtggacatttattcccagctacagcaggaggtaggggcggctggtggggagcttgagcccaagacccgggcatcgctgactggccggctggatgaagtcctgagaaccctcgtcaccaggtattccccgggagctcccagtctggcctagaacagacctcgggaagaaaagaagggggctagagctgtggggagggcaccagcagggacctagcccccaactccccttgtgtcctcctcactcccagttgcttcctggtggagaagcagcccccccaggtactgaagactcagaccaagttccaggctggagttcgattcctgttgggcttgaggttcctgggggccccagccaagcctccgctggtcagggccgacatggtgacagagaagcaggcgcgggagctgagtgtgcctcagggtcctggggctggagcgtaagctgggattggacctggggttggagaagggctgttagggtgatggaggcagcctggagggctggcactgaaaagagcaagggatggggagggagggccatgggatgtggagaccctgaatggtcaaggcagaggaaagggagggacccatttagggctggaatggggtgggggcatcatgatttggccaagatggggactcctcccttaagaacccaaacagagacatggagatttagggctggtgacagtgggtagtctacactcacccatgcactcgccacacctgacgacagtgagatgagctcgttcacactctgacctcccctgggcagagaaagcactggagaaatcatcaacaacactgtgcccttggagaacagcattcctgggaactgctgctctgccctgttcaagaacctggtgaggggctttggggtgcagtgaggggggcaccactaggagactgtgggactctccttggagaggatgtcaggaagcccaggaggagcggtctctgtcctcatgacctcgcccttgctctccctcaccccacccacagcttctcaagaagatcaagcggtgtgagcggaagggcactgagtctgtcacagaggagaagtgcgctgtgctcttctctgccagcttcacacttggccccggcaaactccccatccagctccaggtgaaccgtggcccagccctgccccaatctgggaccccgagtcctcctccaatgccacgcacaagggccctggaccctcacctcttgtgactgccccataccccatgtgtctgggattcatgcacactggggcccgggtgagtgggggtgagcaagagcatggagtgcacagggcagggaatggtagtggatagcagcaaacacttcggaagcacttcctatagaccaggggcactctattaaatgatacatactgcacatgcgtgccagcacacacacgtctggttttcacaataacattatgaggtaggcagtattatcagcctcattttatagcatgaggacattgagacagagagtttaagtagtttgtcccagtcacccagctaagtgttggagctggtatctgaaacctggaagtctggttccatagcgattatagtaaccacttctctacggtgaggccctgattgagcttcaaaacgcatttaataacatggggaaagaaagaaagaaaagaaaccctgtcctcaccctacttcaggccctgtctctgcccctggtggtcatcgtccatggcaaccaagacaacaatgccaaagccactatcctgtgggacaatgccttctctgagatggtgaggaaagtccttggtagttggagggaacagggtgcagggtgggttctaacatgggcagtggtgcaggcctgctgatggggtggtgggcatgtcggatgggtgtgaccttaacacttcttcatgggcctgctttcgtgcttctgacctcttttcaccccagtcttaacaactatcaggccacagcactgtaacctagaaaaaacagcatgtttgtgagcgatatcaggggctgtggaggggtaggccacaggcatgtgggacggatgaaggccggcccgaggaataacaagacggtagcctgcagtgctctcttcttcccccttctccccaggaccgcgtgccctttgtggtggctgagcgggtgccctgggagaagatgtgtgaaactctgaacctgaagttcatggctgaggtggggaccaaccgggggctgctcccagagcacttcctcttcctggcccagaagatcttcaatgacaacagcctcagtatggaggccttccagcaccgttctgtgtcctggtcgcagttcaacaaggttcagttctccgcggccgcgagctctaatacgactcactatagggcgtcgactcgatcataccactgcactcaagcctgggtgacagagcaagactctgtctcaaaaaaaaaaaaaaaaaaaggccaggcatggtggttcatgcctgtaatcccagcactttgggaggccgagacggatagatcacctgaggtcaggagttcgagaccagcctggccaacatggcaaaaccccgtctctactaaaaacaaaaaaatagccaggatggtcgtttgcgtctgtaatcccagctactcggctgaggcaggaggtgaacccaggaggtaaaggctgcaggggaagatgaaaccattgcactccagcctgggcaagactctgtatcaaaaaaaaaaaaaaaaaggctaggtgtggtggctcacacctgtaatcccagcactttgggaggctgaggcgggcggatcacaaggtcaagaaatcgagaccatcctgaccaacatggtgaaaccccgtctctactaaaaatacaaaaattacctgggcatggtggcgcatgcctgtattcccaactactcgggaggctgaggcatgaaaatcacttgaacctgggaggcagaggttgcaggcgagccaagattgtgccactgcactccagcctgccaacaaaaatgagattctgtcggttaccttccctttgggcgtcaacttctgccacacctccttagggagagggtgtagcatagtagttaagaggggtccagggccagaatgcctgggtttaaatcctagctctgcctcttaccagctatgtagacctgggcaagtcattcgacgtttttggacttccatttcttcatctgtaagatggaattattataatccctacttccatagcctggtaaagagcaaataaatatatggaaaggcttgaaatagtggctggcacgtgtaagcattaggattggtcgttgtcattgatggagtctcaggttcggtctgatcctcagcccctgtgattctgtcgtgagggcactcacagctcactgcctgccctaaacaggctccagctctggccctccctcggctcacacctttccccctctccccctaggagatcctgctgggccgtggcttcaccttttggcagtggtttgatggtgtcctggacctcaccaaacgctgtctccggagctactggtctgaccggtgagtccccaccctgggtagtttgagcagccatacaccagtcacctccatactcactgcccatgccccatcctctccttcatcccggccaggctgatcattggcttcatcagcaaacagtacgttactagccttcttctcaatgagcccgacggaacctttctcctccgcttcagcgactcagagattgggggcatcaccattgcccatgtcatccggggccaggatggtgaggccaccccagccagtcctctgtctctgtgcctgtgccctctggggtttcttctgggaatgaaatgtcctgaccttcctgatgccgatcctgatcttcaggaagttcttccagcttctcttcttccttctgtggtctaaatgttcaccttctcactgtgagctctgtgggaacggagactagtgggtctctctccctcaggagccccaccctaggtcctctctcccttgccttggtggagtgagaacaggtcttatggtaggggttggggaaggggaagaaatccggacagagggatctcagggtctccttcctaccataggctctccacagatagagaacatccagccattctctgccaaagacctgtccattcgctcactgggggaccgaatccgggatcttgctcagctcaaaaatctctatcccaagaagcccaaggatgaggctttccggagccactacaagcgtgagctggaactggcagctctgattccttcctgtcacccacttcctgccatgctccccgctgccatcctctccccagcccgtgagttatcctgaggtcactccgaatttccatagctgtgcttttcttacttcccggatgatccatgcccaccttttccacctcccttcctccctaacccgagagcaatccatggcagtcttttccatctcacaacagctgaacagctgaacagatgggtaaggatggcaggggttatgtcccagctaccatcaagatgaccgtggaaaggtgagtgtggtggtatggacagtgggtaggtcaggggcttagtgcttatctgcaggaaggaggggtggcatcaacccttggtcagtcacatgtacctccttccctcctccagggaccaaccacttcctaccccagagctccagatgcctaccatggtgccttcttatgaccttggaatggcccctgattcctccatgagcatgcagcttggcccagatatggtgtaaggagctggaaagacaggaatgggagtggtctgtgcagatgggctaatcttagcatgggcagctgggagagctggcactgggggctgaacagggaatcttcctttccatgagagggacacctgttcaaaagcagggtgtggtggtgtccaggagaagggctggcatcagggggtctgttttctttccccaggccccaggtgtacccaccacactctcactccatccccccgtatcaaggcctctccccagaagaatcagtcaacgtgttgtcagccttccaggagtaagtgaaaaacctcatggggataccatcccactctaagggggtgggcatttgaattgttagaagaggctcttctgtgagaaaggagcagcaaatgctaacagcctgtcttcttctcttctgtccactctaatgagggggtagtagttaagatctggactgcctaggtttgaattctagctccaccacttactggtttggggcaaattacttagcctttggtgccttatctgcacaatgggggataataatgctaataataataacctacctcactgcattattgtggagattaaatgagttcataacacttaaaaagctcgagcatagtgcatggctcatagcaaaagctgtgtaagtccagtcgtggatcacttaatgaaggagcattttctgtctttggcagtttcataattatgcggaataccattgagtataattacacaaacctagatggtatagactactatacactgaggctatattgtgtagcctattgatcctagctttaaacccgagcagcatgatactgttctgaatagtataaggaaatagtaacataatggtaaatatttgtgtgataggaattttcagcttgattataattttttttttttgagacagggtctcactcactggagtgcagtggtgcgatcttagctcccctgcaacctccgcctcttgggctcgagcaatcctcctgctgtagtgcaccacgacactcggctaattcttttttaagatttttctgcagacaaggtctcacttactgcccaagctggtctcaaactcctgggcttaagtgatcctcccacctcggcctcccaaagcgttaggattacaggcgtgagtcactctgcctggccttgattataatcttatgggaccactgtggtctgtagttgacagaaatgtcgttaatgtggtgcatgactgttattattattttctgtcctgcccctgagagccactgtcacttctctgctgtattggtttttgtttactcatctgttttggccttgaaatggcctagacatttttcttcccgaagtatgacactcgggtgcttattaacttagtcaagacacaacatctcccttcccagaaagtgaggcgggagtgaggacttggggacttaagaactaccaaagttcagagtccaaaggaaacattagaaattgggtaatccacccccataacacgcacattttacagatgagaagactgagctcagagcatagaaatagcttgcccaggccatgactaagtcaggataaggagctggagcttgtttcctcactcagtggtcctgactttgcaccactctgcatttgcctagcctgccttcctctaactgtgctctccctacttccaggcctcacctgcagatgccccccagcctgggccagatgaacctgccctttgaccagcctcacccccaggtgaatgacaaaagcccctcctgacccatgtgcctcttctttcctgggccttgcccgctctccttatttccattgctggttcctggcagggcctgctgccgtgccagcctcaggagcatgctgtgtccagccctgaccccctgctctgctcagatgtgaccatggtggaagacagctgcctgagccagccagtgacagcgtttcctcagggcacttggtgagtggcagcttgggagtggaggctgggtggcatctaggggagtgggcgccatgcctactccactgcttctcccatctccttgcaggattggtgaagacatattccctcctctgctgcctcccactgaacaggacctcactaagcttctcctggaggggcaaggggagtcggggggagggtccttgggggcacagcccctcctgcagccctcccactatgggcaatctgggatctcaatgtcccacatggacctaagggccaaccccagttggtgatcccagctggagggagaacccaaagagacagctcttctactacccccacagacctgctctggacacttgctcatgccctgccaagcagcagatggggagggtgccctcctatccccacctactcctgggtcaggaggaaaagactaacaggagaatgcacagtgggtggagccaatccactccttcctttctatcattcccctgcccacctccttccagcactgactggaagggaagttcaggctctgagacacgccccaacatgcctgcacctgcagcgcgcacacgcacgcacacacacatacagagctctctgagggtgatggggctgagcaggaggggggctgggtaagagcacaggttagggcatggaaggcttctccgcccattctgacccagggcctaggacggataggcaggaacatacagacacatttacactagaggccagggatagaggatattgggtctcagccctaggggaatgggaagcagctgaagggaccctgggtgggagcataggaggagtctggacatgtggttactagtacaggttttgccctgattaaaaaatctcccaaagccccaaattcctgttagccaggtggaggcttctgatacgtgtatgagactatgcaaaagtacaagggctgagattcttcgtgtatagctgtgtgaacgtgtatgtacctaggatatgttaaatatatagctggcaccttagttgcatgaccacatagaacatgtgtctatctgcttttgcctacgtgacaacacaaatttgggagggtgagacactgcacagaagacagcagcaagtgtgctggcctctctgacatatgctaacccccaaatactctgaatttggagtctgactgtgcccaagtgggtccaagtggctgtgacatctacgtatggctccacacctccaatgctgcctgggagccagggtgagagtctgggtccaggcctggccatgtggccctccagtgtatgagagggccctgcctgctgcatcttttctgttgccccatccaccgccagcttcccttcactcccctatcccattctccctctcaaggcaggggtcatagatcctaagccataaaataaattttattccaaaataacaaaataaataatctactgtacacaatctgaaaagaaagacgctctaactgctcagataggtgctgcggtccagcccccagctggaggagaccctgagtccaacccaggcctcccgagggggccagtgaagggatcccacacccaccgcccctatgtagggcagggaagaaattgcaaaggacttgggggatagatgggaatgggagggcaaactgcagcacttgttaaattaattaaagaaacaaaccagaagcacaaaaacggggaaggagaagggagaaggagcaggtccagtgttccaggccccaattctgggggcaaatgtgccagcagcacctatctgagcagttagagcgtctttcttttcagattgtgtacagtagattatttattttgttattttggaataaaatttattttatggcttaggatctatgacccctgccttgagagggagaatgggataggggagtgaagggaagctggcggtggatggggcaacagaaaagatgcagcaggcagggccctctcatacactggagggccacatggccaggcctggacccagactctcaccctggctcccaggcagcattggaggtgtggagccatacgtagatgtcacagccacttggacccacttgggcacagtcagactccaaattcagagtatttgggggttagcatatgtcagagaggccagcacacttgctgctgtcttctgtgcagtgtctcaccctcccaaatttgtgttgtcacgtaggcaaaagcagatagacacatgttctatgtggtcatgcaactaaggtgccagctatacatttaacatatcctaggtacatacacgttcacacagctatacacgaagaatctcagcccttgtacttttgcatagtctcatacacgtatcagaagcctccacctggctaacaggaatttggggctttgggagattttttaatcagggcaaaacctgtactagtaaccacatgtccagacccctcctatgctcccacccagggtcccttgagctgcttcccattcccctagggctgagacccaatatcctctatccctggcctctagtgtaaatgtgtctgtatgttcctgcctatccgtcctaggccctgggtcagaatgggcggagaagccttccatgccctaacctgtgctcttacccagcccccctcctgctcagccccatcaccctcagagagctctgtatgtgtgtgtgcgtgcgtgtgcgcgctgcaggtgcaggcatgttggggtgtgtctcagagcctgaacttcccttccagtcagtactggaaggaggtgggcaggggaatgatagaaaggaaggagtggattggctccacccactgtgcattctcctgttagtcttttcctcctgacccaggagtaggtggggataggagggcaccctccccatctgctgcttggcagggcatgagcaagtgtccagagcaggtctgtgggggtagtagaagagctgtctctttgggttctccctccagctgggatcaccaactggggttggcccttaggtccatgtgggacattgagatcccagattgcccatagtgggagggctgcaggaggggctgtgcccccaaggaccctccccccgactccccttgcccctccaggagaagcttagtgaggtcctgttcagtgggaggcagcagaggagggaatatgtcttcaccaatcctgcaaggagatgggagaagcagtggagtaggcatggcgcccactcccctagatgccacccagcctccactcccaagctgccactcac

SEQ ID NO: 2813 - DNA, 3567 bp; single-stranded, linear
cgccatcccgcgctctgcggactgggaggcccgggccaggacgcgagtctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctcggcggcagaaaccgggagtggggccgggcgagtgcgcggcatcccaggccggcccgaacgtccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgcttagtgttgaatgttccccaccgagagcgcatggcttgggaagcgaggcgcgaacccgggccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccagttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagcccgccc

SEQ ID NO: 2814 - DNA, 3805 bp; single-stranded, linear
gaattccgggccgcttagtgttgaatgttccccaccgagagcgcatggcttgggaagcgaggcgcgaacccgggccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaatgacttccggaatct

SEQ ID NO: 2815 - DNA, 7372 bp; single-stranded, linear
cgccatcccgcgctctgcggactgggaggcccgggccaggacgcgagtctgcgcagccgaggttccccagcgccccctgcagccgcgcgtaggcagagacggagcccggccctgcgcctccgcaccacgcccgggaccccacccagcggcccgtacccggagaagcagcgcgagcacccgaagctcccggctcggcggcagaaaccgggagtggggccgggcgagtgcgcggcatcccaggccggcccgaacgtccgcccgcggtgggccgacttcccctcctcttccctctctccttcctttagcccgctggcgccggacacgctgcgcctcatctcttggggcgttcttccccgttggccaaccgtcgcatcccgtgcaactttggggtagtggccgcttagtgttgaatgttccccaccgagagcgcatggcttgggaagcgaggcgcgaacccgggccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccagttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagcccgcccgaattccgggccgcttagtgttgaatgttccccaccgagagcgcatggcttgggaagcgaggcgcgaacccgggccccgaagccgccgtccgggagacggtgatgctgttgctgtgcctgggggtcccgaccggccgcccctacaacgtggacactgagagcgcgctgctttaccagggcccccacaacacgctgttcggctactcggtcgtgctgcacagccacggggcgaaccgatggctcctagtgggtgcgcccactgccaactggctcgccaacgcttcagtgatcaatcccggggcgatttacagatgcaggatcggaaagaatcccggccagacgtgcgaacagctccagctgggtagccctaatggagaaccttgtggaaagacttgtttggaagagagagacaatcagtggttgggggtcacactttccagacagccaggagaaaatggatccatcgtgacttgtgggcatagatggaaaaatatattttacataaagaatgaaaataagctccccactggtggttgctatggagtgccccctgatttacgaacagaactgagtaaaagaatagctccgtgttatcaagattatgtgaaaaaatttggagaaaattttgcatcatgtcaagctggaatatccagtttttacacaaaggatttaattgtgatgggggccccaggatcatcttactggactggctctctttttgtctacaatataactacaaataaatacaaggcttttttagacaaacaaaatcaagtaaaatttggaagttatttaggatattcagtcggagctggtcattttcggagccagcatactaccgaagtagtcggaggagctcctcaacatgagcagattggtaaggcatatatattcagcattgatgaaaaagaactaaatatcttacatgaaatgaaaggtaaaaagcttggatcgtactttggagcttctgtctgtgctgtggacctcaatgcagatggcttctcagatctgctcgtgggagcacccatgcagagcaccatcagagaggaaggaagagtgtttgtgtacatcaactctggctcgggagcagtaatgaatgcaatggaaacaaacctcgttggaagtgacaaatatgctgcaagatttggggaatctatagttaatcttggcgacattgacaatgatggctttgaagatgttgctatcggagctccacaagaagatgacttgcaaggtgctatttatatttacaatggccgtgcagatgggatctcgtcaaccttctcacagagaattgaaggacttcagatcagcaaatcgttaagtatgtttggacagtctatatcaggacaaattgatgcagataataatggctatgtagatgtagcagttggtgcttttcggtctgattctgctgtcttgctaaggacaagacctgtagtaattgttgacgcttctttaagccaccctgagtcagtaaatagaacgaaatttgactgtgttgaaaatggatggccttctgtgtgcatagatctaacactttgtttctcatataagggcaaggaagttccaggttacattgttttgttttataacatgagtttggatgtgaacagaaaggcagagtctccaccaagattctatttctcttctaatggaacttctgacgtgattacaggaagcatacaggtgtccagcagagaagctaactgtagaacacatcaagcatttatgcggaaagatgtgcgggacatcctcaccccaattcagattgaagctgcttaccaccttggtcctcatgtcatcagtaaacgaagtacagaggaattcccaccacttcagccaattcttcagcagaagaaagaaaaagacataatgaaaaaaacaataaactttgcaaggttttgtgcccatgaaaattgttctgctgatttacaggtttctgcaaagattgggtttttgaagccccatgaaaataaaacatatcttgctgttgggagtatgaagacattgatgttgaatgtgtccttgtttaatgctggagatgatgcatatgaaacgactctacatgtcaaactacccgtgggtctttatttcattaagattttagagctggaagagaagcaaataaactgtgaagtcacagataactctggcgtggtacaacttgactgcagtattggctatatatatgtagatcatctctcaaggatagatattagctttctcctggatgtgagctcactcagcagagcggaagaggacctcagtatcacagtgcatgctacctgtgaaaatgaagaggaaatggacaatctaaagcacagcagagtgactgtagcaatacctttaaaatatgaggttaagctgactgttcatgggtttgtaaacccaacttcatttgtgtatggatcaaatgatgaaaatgagcctgaaacgtgcatggtggagaaaatgaacttaactttccatgttatcaacactggcaatagtatggctcccaatgttagtgtggaaataatggtaccaaattcttttagcccccaaactgataagctgttcaacattttggatgtccagactactactggagaatgccactttgaaaattatcaaagagtgtgtgcattagagcagcaaaagagtgcaatgcagaccttgaaaggcatagtccggttcttgtccaagactgataagaggctattgtactgcataaaagctgatccacattgtttaaatttcttgtgtaattttgggaaaatggaaagtggaaaagaagccagtgttcatatccaactggaaggccggccatccattttagaaatggatgagacttcagcactcaagtttgaaataagagcaacaggttttccagagccaaatccaagagtaattgaactaaacaaggatgagaatgttgcgcatgttctactggaaggactacatcatcaaagacccaaacgttatttcaccatagtgattatttcaagtagcttgctacttggacttattgtacttctgttgatctcatatgttatgtggaaggctggcttctttaaaagacaatacaaatctatcctacaagaagaaaacagaagagacagttggagttatatcaacagtaaaagcaatgatgattaaggacttctttcaaattgagagaatggaaaacagactcaggttgtagtaaagaaatttaaaagacactgtttacaagaaaaaatgaattttgtttggacttcttttactcatgatcttgtgacatattatgtcttcatgcaaggggaaaatctcagcaatgattactctttgagatagaagaactgcaaaggtaataatacagccaaagataatctctcagcttttaaatgggtagagaaacactaaagcattcaatttattcaagaaaagtaagcccttgaagatatcttgaaatgaaagtataactgagttaaattatactggagaagtcttagacttgaaatactacttaccatatgtgcttgcctcagtaaaatgaaccccactgggtgggcagaggttcatttcaaatacatctttgatacttgttcaaaatatgttctttaaaaatataattttttagagagctgttcccaaattttctaacgagtggaccattatcactttaaagccctttatttataatacatttcctacgggctgtgttccaacaaccattttttttcagcagactatgaatattatagtattataggccaaactggcaaacttcagactgaacatgtacactggtttgagcttagtgaaatgacttccggaatct

SEQ ID NO: 2816 - DNA, 1108 bp; single-stranded, linear
cagctgtccctccccactgccatttattccttccttcattcaaaccttatgtggctgctacttaccgtgtgttaagtgttcactttttttcttggaattcaaaaaaagaaggacagtatttggggcacagatcttttggtgttctatacatttttttaaagtttcattttacatttgtgtgtgcgtgtgtgtgtgtgtgtgagacagtcttgctctgttgcccaggctggagtgcagtggcataatcattggctcactgtagcctcaaagtcctgggcccaagcgatcttcccacctcagccacccaaaatgctggggttacaggtttatgccactctgtctgacctgaaagttttgggtttactttcccttctttctctttgctgaagtcagagatgatggcagcttccagattctctggtgcctgtgctgggctcgtgctggtcatggtcttgggtccaggattcattctggagactctcagggaagtttcccatgacaaggaaatgtaggagagtgtgctggctttgcgtgctcctctgccaagccctgcttctcctggtgggacacactgaaccacagccagggcattttggtggttagttaaaaaaaaaaaaaaaaaaaaaaaggaagaagaaggcactgtgtaattgtgccggggatcttcagaaattgtaatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggtaaggaaagcccttcactcagggaagaacagaaggggagattttctttgatggttgtttggaagtcaggcttaaacaattgtgtctgtgtgtgcgcatgcacaaacacttttaccttatctttattttcttctttttatttgaatgtatagggttgtgtgtatttctgtgtaaatttggggttttcctcctcttagtctttcacttttgtggtgattaccagtcccatttttagagccagggctgcaacttgaaggttttgct

SEQ ID NO: 2817 - DNA, 540 bp; single-stranded, linear
tgcgttttgggggttcctggagtatcaatcatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgcggcaaaagtactttgtcggttacctaggagagagaacgcagagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcatttcctaactctctgctgaatatggggttggt

SEQ ID NO: 2818 - DNA, 2022 bp; single-stranded, linear
atgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatc

SEQ ID NO: 2819 - DNA, 2500 bp; single-stranded, linear
gggcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgactgaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggtgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaaaaaaaaaaaaaa

SEQ ID NO: 2820 - DNA, 2484 bp; single-stranded, linear
gggcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggtgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcattt

SEQ ID NO: 2821 - DNA, 2497 bp; single-stranded, linear
gggcgccgaggctccccgccgctcgctgctccccggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgtatcaaagtgtaaacaccatagggacccattctacacagagcaggactgcacaggcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcattt

SEQ ID NO: 2822 - DNA, 11181 bp; single-stranded, linear
cagctgtccctccccactgccatttattccttccttcattcaaaccttatgtggctgctacttaccgtgtgttaagtgttcactttttttcttggaattcaaaaaaagaaggacagtatttggggcacagatcttttggtgttctatacatttttttaaagtttcattttacatttgtgtgtgcgtgtgtgtgtgtgtgtgagacagtcttgctctgttgcccaggctggagtgcagtggcataatcattggctcactgtagcctcaaagtcctgggcccaagcgatcttcccacctcagccacccaaaatgctggggttacaggtttatgccactctgtctgacctgaaagttttgggtttactttcccttctttctctttgctgaagtcagagatgatggcagcttccagattctctggtgcctgtgctgggctcgtgctggtcatggtcttgggtccaggattcattctggagactctcagggaagtttcccatgacaaggaaatgtaggagagtgtgctggctttgcgtgctcctctgccaagccctgcttctcctggtgggacacactgaaccacagccagggcattttggtggttagttaaaaaaaaaaaaaaaaaaaaaaaggaagaagaaggcactgtgtaattgtgccggggatcttcagaaattgtaatgatgaaagagtgcaagctctcacttccccttcctgtacagggcaggttgtgcagctggaggcagagcagtcctctctggggagcctgaagcaaacatggatcaagaaactgtaggcaatgttgtcctgttggccatcgtcaccctcatcagcgtggtccagaatggtaaggaaagcccttcactcagggaagaacagaaggggagattttctttgatggttgtttggaagtcaggcttaaacaattgtgtctgtgtgtgcgcatgcacaaacacttttaccttatctttattttcttctttttatttgaatgtatagggttgtgtgtatttctgtgtaaatttggggttttcctcctcttagtctttcacttttgtggtgattaccagtcccatttttagagccagggctgcaacttgaaggttttgcttgcgttttgggggttcctggagtatcaatctgcgttttgggggttcctggagtatcaatcatggatcaagaaactgtaggcaatgttgtcctgttggccatcgtcaccctcatcagcgtggtccagaatggattctttgcccataaagtggagcacgaaagcaggacccagaatgggaggagcttccagaggaccggaacacttgcctttgagcgggtctacactgccaaccagaactgtgtagatgcgtaccccactttcctcgctgtgctctggtctgcggggctactttgcagccaagttcctgctgcgtttgctggactgatgtacttgtttgtgcggcaaaagtactttgtcggttacctaggagagagaacgcagagcacccctggctacatatttgggaaacgcatcatactcttcctgttcctcatgtccgttgctggcatattcaactattacctcatcttctttttcggaagtgactttgaaaactacataaagacgatctccaccaccatctcccctctacttctcatttcctaactctctgctgaatatggggttggtatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatcgggcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgactgaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggtgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttaaaaaaaaaaaaaaaagggcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggtgtctggccaggcctcttggcagtcacatctcttcctccgaggccagtacctttccatttattctttgatcttcagggaactgcatagattgatcaaagtgtaaacaccatagggacccattctacacagagcaggactgcacagcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcatttgggcgccgaggctccccgccgctcgctgctccccggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcggtggattcatacgacgtgactgtggacgaggaactgggcgagatccagctggtcagaatcgagaagcgcaagtactggctgaatgacgactggtacctgaagtacatcacgctgaagacgccccacggggactacatcgagttcccctgctaccgctggatcaccggcgatgtcgaggttgtcctgagggatggacgcgcaaagttggcccgagatgaccaaattcacattctcaagcaacaccgacgtaaagaactggaaacacggcaaaaacaatatcgatggatggagtggaaccctggcttccccttgagcatcgatgccaaatgccacaaggatttaccccgtgatatccagtttgatagtgaaaaaggagtggactttgttctgaattactccaaagcgatggagaacctgttcatcaaccgcttcatgcacatgttccagtcttcttggaatgacttcgccgactttgagaaaatctttgtcaagatcagcaacactatttctgagcgggtcatgaatcactggcaggaagacctgatgtttggctaccagttcctgaatggctgcaaccctgtgttgatccggcgctgcacagagctgcccgagaagctcccggtgaccacggagatggtagagtgcagcctggagcggcagctcagcttggagcaggaggtccagcaagggaacattttcatcgtggactttgagctgctggatggcatcgatgccaacaaaacagacccctgcacactccagttcctggccgctcccatctgcttgctgtataagaacctggccaacaagattgtccccattgccatccagctcaaccaaatcccgggagatgagaaccctattttcctcccttcggatgcaaaatacgactggcttttggccaaaatctgggtgcgttccagtgacttccacgtccaccagaccatcacccaccttctgcgaacacatctggtgtctgaggtttttggcattgcaatgtaccgccagctgcctgctgtgcaccccattttcaagctgctggtggcacacgtgagattcaccattgcaatcaacaccaaggcccgtgagcagctcatctgcgagtgtggcctctttgacaaggccaacgccacagggggcggtgggcacgtgcagatggtgcagagggccatgaaggacctgacctatgcctccctgtgctttcccgaggccatcaaggcccggggcatggagagcaaagaagacatcccctactacttctaccgggacgacgggctcctggtgtgggaagccatcaggacgttcacggccgaggtggtagacatctactacgagggcgaccaggtggtggaggaggacccggagctgcaggacttcgtgaacgatgtctacgtgtacggcatgcggggccgcaagtcctcaggcttccccaagtcggtcaagagccgggagcagctgtcggagtacctgaccgtggtgatcttcaccgcctccgcccagcacgccgcggtcaacttcggccagtacgactggtgctcctggatccccaatgcgcccccaaccatgcgagccccgccaccgactgccaagggcgtggtgaccattgagcagatcgtggacacgctgcccgaccgcggccgctcctgctggcatctgggtgcagtgtgggcgctgagccagttccaggaaaacgagctgttcctgggcatgtacccagaagagcattttatcgagaagcctgtgaaggaagccatggcccgattccgcaagaacctcgaggccattgtcagcgtgattgctgagcgcaacaagaagaagcagctgccatattactacttgtccccagaccggattccgaacagtgtggccatctgagcacactgccagtctcactgtgggaaggccagctgccccagccagatggactccagcctgcctggcaggctgtctggccaggcctcttggcagtcacatctcttcctccgaggccagtacctttccatttattctttgatcttcagggaactgcatagattgtatcaaagtgtaaacaccatagggacccattctacacagagcaggactgcacaggcgtcctgtccacacccagctcagcatttccacaccaagcagcaacagcaaatcacgaccactgatagatgtctattcttgttggagacatgggatgattattttctgttctatttgtgcttagtccaattccttgcacatagtaggtacccaattcaattactattgaatgaattaagaattggttgccataaaaataaatcagttcattt

SEQ ID NO: 2823 - DNA, 2383 bp; single-stranded, linear
ggcacgaggctggctgagccatgatgctgctgccagaacccctgcagagggcctggtttcaggagactcagagtcctctgtgaaaaagcccttggagaggcgccccagcagggctgcacttggctcctgtgaggaaggggctcagggtctgggcccctccgcctgggccgggctgggagccaggcgggcggctgggctgcagcaatggaccgtgagctggcccagcccgcgtccgtgctgagcctgcctgtcgtctgtggccatgccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcatctttgctgggcagggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccctttttattttattacctttcactctctggctgctgggtctgccgtcggtcctgctgctaacctggcaccagagcctctgccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaagcttgtccaaatgaaaaaaaaaaaaaaaaa

SEQ ID NO: 2824 - DNA, 2988 bp; single-stranded, linear
catcacctttttttaagtagtaagaataaagccactgtatgattctcttaatagctatacattaatcctgtttttagtgctgactgggccagccttccgggaactggagtctgtctctttcagtgcttttttgttttttgttggttttttcgagacggggtcgatcacggctcaccacagccttaacctccagggctccagcaatcctcccacctcagcctcctgagtagctgggaccacaggtgtgtgccaccatctccagcagtttgtttatttattttttctttttttttttttggtagaaatgggcttttcgcccatgttgcccaagctggtcttgcacttctgggctgaagcaatcctctcgccttggcctcccagagccttgggattacagaatcatgggtgagagctggcatggcccctagaggtcatttggggtccagctgcctcaccgtatcaatgaggaaactgaggcccagaaaagaaaagcatttttgcccagagtccctcagaaaaaaacagaccacatctgatccttggccctgagtccagagtgggaggcaccgtgacaacaatgcgcagagcagggaatgcagggagccatggatagtgctggggtgcctcaggaaccctgaagctgggctgagccatgatgctgctgccagaacccctgcagagggcctggtttcaggagactcagagtcctctgtgaaaaagcccttggagagcgccccagcagggctgcacttggctcctgtgaggaaggggctcaggggtctgggcccctccgcctgggccgggctgggagccaggcgggcggctgggctgcagcaatggaccgtgagctggcccagcccgcgtccgtgctgagcctgcctgtcgtctgtggcatgcccatcatgggctcctcggtgtacatcacggtggagctggccattgctgtgctggccatcctgggcaatgtgctggtgtgctgggccgtgtggctcaacagcaacctgcagaacgtcaccaactactttgtggtgtcactggcggcggccgacatcgcagtgggtgtgctcgccatcccctttgccatcaccatcagcaccgggttctgcgctgcctgccacggctgcctcttcattgcctgcttcgtcctggtcctcacgcagagctccatcttcagtctcctggccatcgccattgaccgctacattgccatccgcatcccgctccggtacaatggcttggtgaccggcacgagggctaagggcatcattgccatctgctgggtgctgtcgtttgccatcggcctgactcccatgctaggttggaacaactgcggtcagccaaaggagggcaagaaccactcccagggctgcggggagggccaagtggcctgtctctttgaggatgtggtccccatgaactacatggtgtacttcaacttctttgcctgtgtgctggtgcccctgctgctcatgctgggtgtctatttgcggatcttcctggcggcgcgacgacagctgaagcagatggagagccagcctctgccgggggagcgggcacggtccacactgcagaaggaggtccatgctgccaagtcactggccatcattgtggggctctttgccctctgctggctgcccctacacatcatcaactgcttcactttcttctgccccgactgcagccacgcccctctctggctcatgtacctggccatcgtcctctcccacaccaattcggttgtgaatcccttcatctacgcctaccgtatccgcgagttccgccagaccttccgcaagatcattcgcagccacgtcctgaggcagcaagaacctttcaaggcagctggcaccagtgcccgggtcttggcagctcatggcagtgacggagagcaggtcagcctccgtctcaacggccacccgccaggagtgtgggccaacggcagtgctccccaccctgagcggaggcccaatggctatgccctggggctggtgagtggagggagtgcccaagagtcccaggggaacacgggcctcccagacgtggagctccttagccatgagctcaagggagtgtgcccagagccccctggcctagatgaccccctggcccaggatggagcaggagtgtcctgatgattcatggagtttgccccttcctaagggaaggagatctttatctttctggttggcttgaccagtcacgttgggagaagagagagagtgccaggagaccctgagggcagccggttcctactttggactgagagaagggagccccaggctggagcagcatgaggcccagcaagaagggcttgggttctgaggaagcagatgtttcatgctgtgaggccttgcaccaggtgggggccacagcaccagcagcagcatctttctgggcaggcccagccctccactgcagaagcatctggaagcaccaccttgtctccacagagcagcttgggcacagcagactggcctggccctgagactggggagtggctccaacagcctcctgccacccacacaccactctccctagactctcctagggttcaggagctgctgggcccagaggtgacatttgacttttttccaggaaaaatgtaagtgtgaggaaaccccttttattttattacctttcactctctggctgctgggtctgccgtcggtcctgctgctaacctggcagcagagcctctgcccggggagcctcaggcagtcctctcctgctgtcacagctgccatccacttctcagtcccagggccatctcttggagtgacaaagctgggatcaaggacagggagttgtaacagagcagtgccagagcatgggcccaggtcccaggggagaggttggggctggcaggccactggcatgtgctgagtagcgcagagctacccagtgagaggccttgtctaactgcctttccttctaaagggaatgtttttttctgagataaaataaaaacgagccacatcgtgttttaag

SEQ ID NO: 2825 - DNA, 2156 bp; single-stranded, linear
ggcacgagcccagaaacaaagacttcacggacaaagtcccttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtcacagccacttgggatagagagggaatgtaatggtggcctggggcttctgaggcttctggggcttcagtcttttccatgaacttctcccctggtagaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaagaacttggaaatagtgatttccacagtgactccactctgagtcccagagccaatcagtagccagcatctgcctccccttcactcccaccgcaggatttgggctcttggaatcctggggaacatagaactcatgacggaagagttgagacctaacgagaaatagaaatgggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcgattaataacaggcaaaaggaagcagggttggtttcccttctttttgttcttcatctaagccttctggttttatgggtcagagttccgactgccatcttggacttgtcagcaaaaaaaaaaaaaaaaa

SEQ ID NO: 2826 - DNA, 949 bp; single-stranded, linear
agaagcttttgctcctgggattaggttgatgggcctctaatgtcaccagtgaaatgggatattagatattttccagctaggatacgacagctcccaataaaaccaaattactaagccttttctgcaagcaaggagccgtctggaacataaggactttaaccttgggtaggagacaggcaagcagaagtcttcaattgtgtcacaattttcactgaggactcaagtgacctaagaaagtaattgtgattgtcagagccttgttcttccttttctttctccagccgcacgcttcacctactcaggagagtgcctacgcaatctgacttgacagcttctagaaagaaattagagcaacaggggtctcagcagggtggtcttgggccaaacactgaaagcaggcaggcttaccctttcctcttctgcccccttcaactttttcctgatgttcttacccacatccctcaccacaccacaccctttcattcatccttgtcccagacttattaagtatatacagataagcaatccagggaacttgcattcattaggagaaacccagaaattcaaaagcaataatgatctaatcccagaggagtagaaaacaggaagtgggcagctgccagctttcttgctttgctggagtattctggaatttgatgggttgagggttctggacacaatgccccaagccccttccttgttgtgctgggttcctatttctgctctcggcactgacttagcagctgctcaagagctcactatgttggcttggattacactggtctcacccacatctccggcagtttgtgggcaaacctcctgagcagccttgggtgatgaaacctttcatggtagcaggagaatgggactgtgaattctcaatcccctgtccccaccccttccttcctctctcagggccttaaagtctaggaggaggaagcacagcagc

SEQ ID NO: 2827 - DNA, 3734 bp; single-stranded, linear
cttgctttgctggagtattctggtaatttgatgggttgagggttctggacacaatgccccaagccccttccttgttgtgctgggttcctatttctgctctcggcactgacttagcagctgctcaagagctcactatgttggcttggattacacggtctcacccacatctccggcagtttgtgggcaaacctcctgagcagccttgggtgatgaaacctttcatggtagcaggagaatgggactgtgaattctcaatcccctgtccccaccccttccttcctctctcagggccttaaagtctaggaggaggaagcacagcagcaactgactgggcagcctttcaggaaagatgcagccactcctgcttctgctggcctttctcctacccactggggctgaggcaggtgagtgaccatccccaccctcagaggcctgacctcatcccatagattcttgagccaaattgccttggtatatcctaattctgtactgttgagcaagttatttgaatttgtgtttcctcatctataaaatgagaataatattaataccgatcttgcagagttgccatgagagttaaataagttagagtatttaaatgtcttggaattgcccgcacactataagtgctataaaaacatgctttgtgtaaataatttggcagcatgtgtcagaccctacctaggaggtaagaatacagcaataacagtaccatcagctcatgtctagatttttaaacaccagtcccacgtggtcttgaattggactcagagggctctgggaagctccatgaggataaaagtataagggaacttcaggaacaatcctgtacttacagcaaagcattctcctcaatacctgaggctgaagctggccttgcctggaacaagggttgttctccctcttttggagaggaggagggaggtgaggcctaggatggggaaaagggctcctttcaagacagcagtgtttcctgtagaaccctggagccccctcccaatctgctgccccatagactccaagcctcagcaccatctcctccctctcctgcaccctctctcctgccgtccccatcttccagcctttctggagccaccaatctggtacccacattgcaggttcagcaagcatagagctaagtgccaaatgcttccttccaggggagatcatcggaggccgggagagcaggccccactcccgcccctacatggcgtatcttcagatccagagtccagcaggtcagagcagatgtggagggttcctggtgcgagaagactttgtgctgacagcagctcattgctggggaaggtgaggagctaaggaacttcctggccagccaggaacacagccctgcggagctcttcggtggaagagccatctgaaagaagagttgtagcaatgaaagggtgaaagaaagaccaagtgagtctttgcgggagggaacaggccagtgtaaatgaggaggaaaggaggataagatcaaaaagagcaagaggaagagatggaagacacatattggggctcaaaatataaactcaggctatttatcaacttaatctggggaagtaaacctgaaggcaagtaccaccctgtcatccctagctcagagctgctgagaaagaggatacagctgagccccagggccctcccatcccctcgattctggttagctgcagtcttgccctccccgtgctgtctgcctaccctgcagagctggtggaccatagctcctgcagcccagacctacctcttgcttttgcagcaatataaatgtcaccctgggcgcccacaatatccagagacgggaaaacacccagcaacacatcactgcgcgcagagccatccgccaccctcaatataatcagcggaccatccagaatgacatcatgttattgcaggtaccacctacctggccctctggctccttcctagtgtgtccggggacaatggaggaggaagtgagggcaaggctccggggtggcggggagggcatgggatgtgtactgcaccagcgacccccgagccttggctggaggccccagctgagcgggaacgcctacattcttcctccagctgagcagaagagtcagacggaatcgaaacgtgaacccagtggctctgcctagagcccaggagggactgagacccgggacgctgtgcactgtggccggctggggcagggtcagcatgaggaggggaacagatacactccgagaggtgcagctgagagtgcagagggataggcagtgcctccgcatcttcggttcctacgacccccgaaggcagatttgtgtgggggaccggcgggaacggaaggctgccttcaaggtaaggcatgggcattggccaacacaccccgggagagaggggcccgtgcagagccaggcagtgcgaacagattccatccccacagcctcagcctggcagccagaccagggtgggctggggattgttttccccatcaacctggtctctgggggaataggaggaagacccacaacacatacataggcaacattctcctggagaagggagaggtaccttgactcagattgggctggagacagtaattaaggcagagctgaagtccagcgaccgaaaagatccagaggcttggctcctgtaccccaccgatcttccatctcacacacacccagcaattgaaggggcccacccacccctgccttccctgagagcccggagctcagggaagcaggagcagggaggcctgtctcagtctcccttctcctctctacctacagggggattccggaggccccctgctgtgtaacaatgtggcccacggcatcgtctcctatggaaagtcgtcaggggttcctccagaagtcttcaccagggtctcaagtttcctgccctggataaggacaacaatgagaagcttcaaactgctggatcagatggagacccccctgtgactgactcttcttctcggggacacaggccagctccacagtgttgccagagccttaataaacgtccacagagtataaataaccaattcctcatttgttcattaaacgtcattcagtacttagtttgtttggattgctacaacaaaatagcacaaattgggtggcttataaataacaaatttatttctcacaggtctagaggctaagaagtctaagatcaagtcactagcagattcagtgtctaattagggcccattttctggttcacagacaaccatcctctccctgtgtccacatatggcaaaaggggcaagggaattctctgatgtctcttttacaagggacctagtctcattcaaagagctcagcttttacgacctaatcacatcccaaaggccccacctaatgccatcacgacattggggattaggtctgggaaacatagggaaagagtgtctctacacaaaaattttaaaattagccaggcatggtggcatgtgtctatagtcccagctacttgggaggctaaagtggaaggattagttgaacccacgaggttgaggcttcagtgaaccatgcactccagcctgagcgacagagcaagacaccattccaagaaagaaaaaaaaaaagactggcaggccaaaaagacagaactgaaattccaaaaaaaaagacctactttagtgtatgaaaaaggtggcatctcaaatcactgggaaacaatggaatttttgaataaatagcattagaaccaacctagatagatatttggaggggatggaaggtataattggatcc

SEQ ID NO: 2828 - DNA, 4683 bp; single-stranded, linear
agaagcttttgctcctgggattaggttgatgggcctctaatgtcaccagtgaaatgggatattagatattttccagctaggatacgacagctcccaataaaaccaaattactaagccttttctgcaagcaaggagccgtctggaacataaggactttaaccttgggtaggagacaggcaagcagaagtcttcaattgtgtcacaattttcactgaggactcaagtgacctaagaaagtaattgtgattgtcagagccttgttcttccttttctttctccagccgcacgcttcacctactcaggagagtgcctacgcaatctgacttgacagcttctagaaagaaattagagcaacaggggtctcagcagggtggtcttgggccaaacactgaaagcaggcaggcttaccctttcctcttctgcccccttcaactttttcctgatgttcttacccacatccctcaccacaccacaccctttcattcatccttgtcccagacttattaagtatatacagataagcaatccagggaacttgcattcattaggagaaacccagaaattcaaaagcaataatgatctaatcccagaggagtagaaaacaggaagtgggcagctgccagctttcttgctttgctggagtattctggaatttgatgggttgagggttctggacacaatgccccaagccccttccttgttgtgctgggttcctatttctgctctcggcactgacttagcagctgctcaagagctcactatgttggcttggattacactggtctcacccacatctccggcagtttgtgggcaaacctcctgagcagccttgggtgatgaaacctttcatggtagcaggagaatgggactgtgaattctcaatcccctgtccccaccccttccttcctctctcagggccttaaagtctaggaggaggaagcacagcagccttgctttgctggagtattctggtaatttgatgggttgagggttctggacacaatgccccaagccccttccttgttgtgctgggttcctatttctgctctcggcactgacttagcagctgctcaagagctcactatgttggcttggattacacggtctcacccacatctccggcagtttgtgggcaaacctcctgagcagccttgggtgatgaaacctttcatggtagcaggagaatgggactgtgaattctcaatcccctgtccccaccccttccttcctctctcagggccttaaagtctaggaggaggaagcacagcagcaactgactgggcagcctttcaggaaagatgcagccactcctgcttctgctggcctttctcctacccactggggctgaggcaggtgagtgaccatccccaccctcagaggcctgacctcatcccatagattcttgagccaaattgccttggtatatcctaattctgtactgttgagcaagttatttgaatttgtgtttcctcatctataaaatgagaataatattaataccgatcttgcagagttgccatgagagttaaataagttagagtatttaaatgtcttggaattgcccgcacactataagtgctataaaaacatgctttgtgtaaataatttggcagcatgtgtcagaccctacctaggaggtaagaatacagcaataacagtaccatcagctcatgtctagatttttaaacaccagtcccacgtggtcttgaattggactcagagggctctgggaagctccatgaggataaaagtataagggaacttcaggaacaatcctgtacttacagcaaagcattctcctcaatacctgaggctgaagctggccttgcctggaacaagggttgttctccctcttttggagaggaggagggaggtgaggcctaggatggggaaaagggctcctttcaagacagcagtgtttcctgtagaaccctggagccccctcccaatctgctgccccatagactccaagcctcagcaccatctcctccctctcctgcaccctctctcctgccgtccccatcttccagcctttctggagccaccaatctggtacccacattgcaggttcagcaagcatagagctaagtgccaaatgcttccttccaggggagatcatcggaggccgggagagcaggccccactcccgcccctacatggcgtatcttcagatccagagtccagcaggtcagagcagatgtggagggttcctggtgcgagaagactttgtgctgacagcagctcattgctggggaaggtgaggagctaaggaacttcctggccagccaggaacacagccctgcggagctcttcggtggaagagccatctgaaagaagagttgtagcaatgaaagggtgaaagaaagaccaagtgagtctttgcgggagggaacaggccagtgtaaatgaggaggaaaggaggataagatcaaaaagagcaagaggaagagatggaagacacatattggggctcaaaatataaactcaggctatttatcaacttaatctggggaagtaaacctgaaggcaagtaccaccctgtcatccctagctcagagctgctgagaaagaggatacagctgagccccagggccctcccatcccctcgattctggttagctgcagtcttgccctccccgtgctgtctgcctaccctgcagagctggtggaccatagctcctgcagcccagacctacctcttgcttttgcagcaatataaatgtcaccctgggcgcccacaatatccagagacgggaaaacacccagcaacacatcactgcgcgcagagccatccgccaccctcaatataatcagcggaccatccagaatgacatcatgttattgcaggtaccacctacctggccctctggctccttcctagtgtgtccggggacaatggaggaggaagtgagggcaaggctccggggtggcggggagggcatgggatgtgtactgcaccagcgacccccgagccttggctggaggccccagctgagcgggaacgcctacattcttcctccagctgagcagaagagtcagacggaatcgaaacgtgaacccagtggctctgcctagagcccaggagggactgagacccgggacgctgtgcactgtggccggctggggcagggtcagcatgaggaggggaacagatacactccgagaggtgcagctgagagtgcagagggataggcagtgcctccgcatcttcggttcctacgacccccgaaggcagatttgtgtgggggaccggcgggaacggaaggctgccttcaaggtaaggcatgggcattggccaacacaccccgggagagaggggcccgtgcagagccaggcagtgcgaacagattccatccccacagcctcagcctggcagccagaccagggtgggctggggattgttttccccatcaacctggtctctgggggaataggaggaagacccacaacacatacataggcaacattctcctggagaagggagaggtaccttgactcagattgggctggagacagtaattaaggcagagctgaagtccagcgaccgaaaagatccagaggcttggctcctgtaccccaccgatcttccatctcacacacacccagcaattgaaggggcccacccacccctgccttccctgagagcccggagctcagggaagcaggagcagggaggcctgtctcagtctcccttctcctctctacctacagggggattccggaggccccctgctgtgtaacaatgtggcccacggcatcgtctcctatggaaagtcgtcaggggttcctccagaagtcttcaccagggtctcaagtttcctgccctggataaggacaacaatgagaagcttcaaactgctggatcagatggagacccccctgtgactgactcttcttctcggggacacaggccagctccacagtgttgccagagccttaataaacgtccacagagtataaataaccaattcctcatttgttcattaaacgtcattcagtacttagtttgtttggattgctacaacaaaatagcacaaattgggtggcttataaataacaaatttatttctcacaggtctagaggctaagaagtctaagatcaagtcactagcagattcagtgtctaattagggcccattttctggttcacagacaaccatcctctccctgtgtccacatatggcaaaaggggcaagggaattctctgatgtctcttttacaagggacctagtctcattcaaagagctcagcttttacgacctaatcacatcccaaaggccccacctaatgccatcacgacattggggattaggtctgggaaacatagggaaagagtgtctctacacaaaaattttaaaattagccaggcatggtggcatgtgtctatagtcccagctacttgggaggctaaagtggaaggattagttgaacccacgaggttgaggcttcagtgaaccatgcactccagcctgagcgacagagcaagacaccattccaagaaagaaaaaaaaaaagactggcaggccaaaaagacagaactgaaattccaaaaaaaaagacctactttagtgtatgaaaaaggtggcatctcaaatcactgggaaacaatggaatttttgaataaatagcattagaaccaacctagatagatatttggaggggatggaaggtataattggatcc

SEQ ID NO: 2829 - DNA, 2156 bp; single-stranded, linear; identical to SEQ ID NO: 2825

SEQ ID NO: 2830 - DNA, 2955 bp; single-stranded, linear
gagagccccccccccgagactgaaagttttggagattcaggggtcgggggaaagggttcaggaaatggtaattgagtttccaagggatagtgttacaagtggtatgggaggccccctatttctgatagtaatagagaatattttctttgttcattatgatagaacccgtgggataaagagggaaaataaatgttgggagtcccccaggggagaggagagaatccaacagggtgatttgctgatatttgtacgaggagggaaagaatttttcaaagacaaagttggagtgaggagtttttgtagagggaaccaggtggggtacaaagagagagacacactgagccggtgggaagggaagaattaagaggggtgttcccccacactgtatattaagaaagaaaaacaatggggacaggacggcagaagttagagtttcttaaccaggatgagagggggatttcacggtaactaatgagtgatttcagaccttattccactatcccagggcaatcagatattaatcatgtacaagttgaaatcatgcgtgtcctttgaggtaagacttacataatcctatttagcataacaggcccccagatccagaaaggggagggttccgcccctatcactgaaggggatcagggatatgaaagtggctcatggttgaccatcacgtttaacaggaatgggcaatcaggaggggtaggtccaattgtgaccaacagaccaaacttccattaatgcttgcggttcttgtggcaaagccagtctgtgaggtttgatggggatggacttggtgagcagagagcagggggacaacgaatcccagaagctgaggggaatggggttccaaagagccgctgctgcctctgggagcacccatgtcagttagtttttccgtacgggactcagggttccagattattcgtttttaaatccttccattcacaatctttaagaagaagaaaaaaaagaagtctgccgctgaccacaagagctctatgccctgcccccatcccacatacacacatcccacacttcaattgctccaaacattctgggaacatctcactgccacccacctcacccaactcagcttcacctgcccccaattcccttaaggctgagctcccagggccaagactcaagaggctcagagtgagcagagaaaatcctcgcagttaacttggcttccaggaagtggccactggtgggcgttgtggccattcatgagcaccaaaccacacaaaaagaactttgtccctttcttgtcattttgaaagactgtgaaactggagccaattctccatcatcacacaggaagctgagtacttcctacttggtcaggatcttgaaacttgaattcataaaacccagaaagccccagaaacaaagacttcacggacaaagtcccttggaaccagagtaagtgtcacttgtcttttctgtcttatctgttactgtggagggcagtgttgttcaaagacatgcatgcagctaggggctcctcaaaggtagggggaattctttgagtaggctgggcaaatgtctaagtagcccatggatgcatctccaaggcaattaatactgtagcaatactgagaatggtggatttataaagctgggtgctcagatgaaatataggcttttttgctaaaaaggaagcttacttgaaggattggcttttggttactgattaagaaagtcagtcagtactaagggacaaaaggtgttttctgtggaaacctattcaataagaaattacttggcggggcgcagtggctcacggctgtaatcccagcactttgggagaccgaggcaggtggatcatgaggtcaagagatggagacaatcctggccatatggtgaaaccctgtctctactaaaaataaaaattagccgggcaggtggccgcagcctgttagtcccagctactcaagaggctgaggcaggagaatcactcgaatccgggaggtggaggttgcagtgagctgagattgcaccacaacactccagcctggcgacagagcaagagtctgtctgaaaaaaaaaaattgcttgccaaattcccccaagtaaaggaaaaccaaacatggtgtatgaagaaattatagcaagagggaaatattagctagaaaaatcttggcagatgcaaggatgatttgatactgaacctatctcttaagaagactagaaccaaggatcctcaaaattggcactgctatctttggaagagaggtaggctttcactcacccaaaggcaaggagctggccaggtgatcttggggggcatctgttctgctctactaacaaagacacaggtcaggattttgttctgaagatagaggggcatggtggctccgtataggtatctacttcataggtggccttggtgggtcccagatttcaaagaagagatggaaactcccaaaagtttgcacaacctggcaccaggctatgtgccactcactgatcctttagtccccgcaccgagcagtgggacagtgctggactgttcagaatgtggggcctgggcagtgatgtgctggtaaatgttcaacaactgactcttctgaagaaaagatccctgctttataacatttgttgattttcatggtataaatgcccccactgtggtcagtttcaagctaccaacatgctgaatgtggagtggggaagagatgcacgcaattggcatttataaaccagtataagccagccagcgcaccataggcctgggtgtctttcaccatcacagactgctctactctgctcagagactcaccaactcccaggctggaagacactagcagtggaaggtccaggatccagggctatactgaccactgtgccagtggccttgaggcagactctgcagtagacaacanccagggctggccnattagatgacaacatgnccttggtccctctcgggcccaacccagacacctcctg

SEQ ID NO: 2831 - DNA, 1495 bp; single-stranded, linear
atggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgaccagcagcctggctctcccagccaggttctgactcttggcacagcatggagtccgcctcttggatagagaggaatgtaatggtggcctggggcttctgaggcttctgggcttgagtcttttccatgaacttctcccctggtagaaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgagga

SEQ ID NO: 2832 - DNA, 6606 bp; single-stranded, linear
ggcacgagcccagaaacaaagacttcacggacaaagtcccttggaaccagagagaagccgggatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgagccagcagcctggctctcccagccaggttctgactcttggcacagcatggagtcacagccacttgggatagagagggaatgtaatggtggcctggggcttctgaggcttctggggcttcagtcttttccatgaacttctcccctggtagaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgaggaatttctgttcttccatcacctccccccccccgccaccctcccactgccaagaacttggaaatagtgatttccacagtgactccactctgagtcccagagccaatcagtagccagcatctgcctccccttcactcccaccgcaggatttgggctcttggaatcctggggaacatagaactcatgacggaagagttgagacctaacgagaaatagaaatgggggaactactgctggcagtggaactaagaaagcccttaggaagaatttttatatccactaaaatcaaacaattcagggagtgggctaagcacgggccatatgaataacatggtgtgcttcttaaaatagccataaaggggagggactcatcatttccatttacccttcttttctgactatttttcagaatctctcttcttttcaagttgggtgatatgttggtagattctaatggctttattgcagcgattaataacaggcaaaaggaagcagggttggtttcccttctttttgttcttcatctaagccttctggttttatgggtcagagttccgactgccatcttggacttgtcagcaaaaaaaaaaaaaaaaagagagccccccccccgagactgaaagttttggagattcaggggtcgggggaaagggttcaggaaatggtaattgagtttccaagggatagtgttacaagtggtatgggaggccccctatttctgatagtaatagagaatattttctttgttcattatgatagaacccgtgggataaagagggaaaataaatgttgggagtcccccaggggagaggagagaatccaacagggtgatttgctgatatttgtacgaggagggaaagaatttttcaaagacaaagttggagtgaggagtttttgtagagggaaccaggtggggtacaaagagagagacacactgagccggtgggaagggaagaattaagaggggtgttcccccacactgtatattaagaaagaaaaacaatggggacaggacggcagaagttagagtttcttaaccaggatgagagggggatttcacggtaactaatgagtgatttcagaccttattccactatcccagggcaatcagatattaatcatgtacaagttgaaatcatgcgtgtcctttgaggtaagacttacataatcctatttagcataacaggcccccagatccagaaaggggagggttccgcccctatcactgaaggggatcagggatatgaaagtggctcatggttgaccatcacgtttaacaggaatgggcaatcaggaggggtaggtccaattgtgaccaacagaccaaacttccattaatgcttgcggttcttgtggcaaagccagtctgtgaggtttgatggggatggacttggtgagcagagagcagggggacaacgaatcccagaagctgaggggaatggggttccaaagagccgctgctgcctctgggagcacccatgtcagttagtttttccgtacgggactcagggttccagattattcgtttttaaatccttccattcacaatctttaagaagaagaaaaaaaagaagtctgccgctgaccacaagagctctatgccctgcccccatcccacatacacacatcccacacttcaattgctccaaacattctgggaacatctcactgccacccacctcacccaactcagcttcacctgcccccaattcccttaaggctgagctcccagggccaagactcaagaggctcagagtgagcagagaaaatcctcgcagttaacttggcttccaggaagtggccactggtgggcgttgtggccattcatgagcaccaaaccacacaaaaagaactttgtccctttcttgtcattttgaaagactgtgaaactggagccaattctccatcatcacacaggaagctgagtacttcctacttggtcaggatcttgaaacttgaattcataaaacccagaaagccccagaaacaaagacttcacggacaaagtcccttggaaccagagtaagtgtcacttgtcttttctgtcttatctgttactgtggagggcagtgttgttcaaagacatgcatgcagctaggggctcctcaaaggtagggggaattctttgagtaggctgggcaaatgtctaagtagcccatggatgcatctccaaggcaattaatactgtagcaatactgagaatggtggatttataaagctgggtgctcagatgaaatataggcttttttgctaaaaaggaagcttacttgaaggattggcttttggttactgattaagaaagtcagtcagtactaagggacaaaaggtgttttctgtggaaacctattcaataagaaattacttggcggggcgcagtggctcacggctgtaatcccagcactttgggagaccgaggcaggtggatcatgaggtcaagagatggagacaatcctggccatatggtgaaaccctgtctctactaaaaataaaaattagccgggcaggtggccgcagcctgttagtcccagctactcaagaggctgaggcaggagaatcactcgaatccgggaggtggaggttgcagtgagctgagattgcaccacaacactccagcctggcgacagagcaagagtctgtctgaaaaaaaaaaattgcttgccaaattcccccaagtaaaggaaaaccaaacatggtgtatgaagaaattatagcaagagggaaatattagctagaaaaatcttggcagatgcaaggatgatttgatactgaacctatctcttaagaagactagaaccaaggatcctcaaaattggcactgctatctttggaagagaggtaggctttcactcacccaaaggcaaggagctggccaggtgatcttggggggcatctgttctgctctactaacaaagacacaggtcaggattttgttctgaagatagaggggcatggtggctccgtataggtatctacttcataggtggccttggtgggtcccagatttcaaagaagagatggaaactcccaaaagtttgcacaacctggcaccaggctatgtgccactcactgatcctttagtccccgcaccgagcagtgggacagtgctggactgttcagaatgtggggcctgggcagtgatgtgctggtaaatgttcaacaactgactcttctgaagaaaagatccctgctttataacatttgttgattttcatggtataaatgcccccactgtggtcagtttcaagctaccaacatgctgaatgtggagtggggaagagatgcacgcaattggcatttataaaccagtataagccagccagcgcaccataggcctgggtgtctttcaccatcacagactgctctactctgctcagagactcaccaactcccaggctggaagacactagcagtggaaggtccaggatccagggctatactgaccactgtgccagtggccttgaggcagactctgcagtagacaacanccagggctggccnattagatgacaacatgnccttggtccctctcgggcccaacccagacacctcctgatggaaactccaaacaccacagaggactatgacacgaccacagagtttgactatggggatgcaactccgtgccagaaggtgaacgagagggcctttggggcccaactgctgccccctctgtactccttggtatttgtcattggcctggttggaaacatcctggtggtcctggtccttgtgcaatacaagaggctaaaaaacatgaccagcatctacctcctgaacctggccatttctgacctgctcttcctgttcacgcttcccttctggatcgactacaagttgaaggatgactgggtttttggtgatgccatgtgtaagatcctctctgggttttattacacaggcttgtacagcgagatctttttcatcatcctgctgacgattgacaggtacctggccatcgtccacgccgtgtttgccttgcgggcacggaccgtcacttttggtgtcatcaccagcatcatcatttgggccctggccatcttggcttccatgccaggcttatacttttccaagacccaatgggaattcactcaccacacctgcagccttcactttcctcacgaaagcctacgagagtggaagctgtttcaggctctgaaactgaacctctttgggctggtattgcctttgttggtcatgatcatctgctacacagggattataaagattctgctaagacgaccaaatgagaagaaatccaaagctgtccgtttgatttttgtcatcatgatcatcttttttctcttttggaccccctacaatttgactatacttatttctgttttccaagacttcctgttcacccatgagtgtgagcagagcagacatttggacctggctgtgcaagtgacggaggtgatcgcctacacgcactgctgtgtcaacccagtgatctacgccttcgttggtgagaggttccggaagtacctgcggcagttgttccacaggcgtgtggctgtgcacctggttaaatggctccccttcctctccgtggacaggctggagagggtcagctccacatctccctccacaggggagcatgaactctctgctgggttctgactcagaccataggaggccaacccaaaataagcaggcgtgacctgccaggcacactgaccagcagcctggctctcccagccaggttctgactcttggcacagcatggagtccgcctcttggatagagaggaatgtaatggtggcctggggcttctgaggcttctgggcttgagtcttttccatgaacttctcccctggtagaaaagaagatgaatgagcaaaaccaaatattccagagactgggactaagtgtaccagagaagggcttggactcaagcaagatttcagatttgtgaccattagcatttgtcaacaaagtcacccacttcccactattgcttgcacaaaccaattaaacccagtagtggtgactgtgggctccattcaaagtgagctcctaagccatgggagacactgatgtatgagga

SEQ ID NO: 2833 - DNA, 1068 bp; single-stranded, linear
atgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttag

SEQ ID NO: 2834 - DNA, 1201 bp; single-stranded, linear
tttttcttcttctatcacagggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagt

SEQ ID NO: 2835 - DNA, 1689 bp; single-stranded, linear
aatccttttcctggcacctctgatatccttttgaaattcatgttaaagaatccctaggctgctatcacatgtggcatctttgttgagtacatgaataaatcaactggtgtgttttacggaggatgattatgcttcattgtgggattgtatttttcttcttctatcacagggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggacgaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtagatgcagaaaattgcctaaagaggaaggaccaaggagatnaagcaaacacattaagccttccacactcacctctaaaacagtccttcaaaccttccagtgcaacactgaagctcttaagacactgaaatatacacacagcagtagcagtagatgcatgtaccctaaggtcattaccacaggccagggctgggcagcgtactcatcatcaacctaaaaagcagagctttgcttctctctctaaaatgagttacctatattttaatgcacctgaatgttagatagttactatatgccgctacaaaaaggtaaaactttttatattttatacattaacttcagccagctattatataaataaaacattttcacacaatacaataagttaactattttattttctaatgtgcctagttctttccctgcttaatgaaaagctt

SEQ ID NO: 2836 - DNA, 3958 bp; single-stranded, linear
atgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttagtttttcttcttctatcacagggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggagcaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtcagatgcagaaaattgcctaaagaggaaggaccaaggagatgaagcaaacacattaagccttccacactcacctctaaaacagtccttcaaacttccagtaatccttttcctggcacctctgatatccttttgaaattcatgttaaagaatccctaggctgctatcacatgtggcatctttgttgagtacatgaataaatcaactggtgtgttttacggaggatgattatgcttcattgtgggattgtatttttcttcttctatcacagggagaagtgaaatgacaacctcactagatacagttgagacctttggtaccacatcctactatgatgacgtgggcctgctctgtgaaaaagctgataccagagcactgatggcccagtttgtgcccccgctgtactccctggtgttcactgtgggcctcttgggcaatgtggtggtggtgatgatcctcataaaatacaggaggctccgaattatgaccaacatctacctgctcaacctggccatttcggacctgctcttcctcgtcacccttccattctggatccactatgtcagggggcataactgggtttttggccatggcatgtgtaagctcctctcagggttttatcacacaggcttgtacagcgagatctttttcataatcctgctgacaatcgacaggtacctggccattgtccatgctgtgtttgcccttcgagcccggactgtcacttttggtgtcatcaccagcatcgtcacctggggcctggcagtgctagcagctcttcctgaatttatcttctatgagactgaagagttgtttgaagagactctttgcagtgctctttacccagaggatacagtatatagctggaggcatttccacactctgagaatgaccatcttctgtctcgttctccctctgctcgttatggccatctgctacacaggaatcatcaaaacgctgctgaggtgccccagtaaaaaaaagtacaaggccatccggctcatttttgtcatcatggcggtgtttttcattttctggacaccctacaatgtggctatccttctctcttcctatcaatccatcttatttggaaatgactgtgagcggacgaagcatctggacctggtcatgctggtgacagaggtgatcgcctactcccactgctgcatgaacccggtgatctacgcctttgttggagagaggttccggaagtacctgcgccacttcttccacaggcacttgctcatgcacctgggcagatacatcccattccttcctagtgagaagctggaaagaaccagctctgtctctccatccacagcagagccggaactctctattgtgttttaggtagatgcagaaaattgcctaaagaggaaggaccaaggagatnaagcaaacacattaagccttccacactcacctctaaaacagtccttcaaaccttccagtgcaacactgaagctcttaagacactgaaatatacacacagcagtagcagtagatgcatgtaccctaaggtcattaccacaggccagggctgggcagcgtactcatcatcaacctaaaaagcagagctttgcttctctctctaaaatgagttacctatattttaatgcacctgaatgttagatagttactatatgccgctacaaaaaggtaaaactttttatattttatacattaacttcagccagctattatataaataaaacattttcacacaatacaataagttaactattttattttctaatgtgcctagttctttccctgcttaatgaaaagctt

SEQ ID NO: 2837 - DNA, 2961 bp; single-stranded, linear
tctagagccaaggtcacggaagcccagagggcatcttgtggctcgggagtagctctctgctgtcttctcagctctgctgacaatacttgagattttcagatgtcaccaaccaccaagagagcttgatatgactgtatatagtatagtcataaagaacctgaacttgaccatatacttatgtcatgtggaaaatttctcatagcttcagatagattatatctggagtgaagaatcctgccacctatgtatctggcatagtgtgagtcctcataaatgcttactggtttgaagggcaacaaaatagtgaacagagtgaaaatccccactaagatcctgggtccagaaaaagatgggaaacctgtttagctcacccgtgagcccatagttaaaactctttagacaacaggttttttccgtttacagagaacaataatattgggtggtgagcatctgtgtgggggttggggtgggataggggatacggggagagtggagaaaaagggggcacagggttaatgtgaagtccaggatccccctctacatttaaagttggtttaagttggctttaattaatagcaactcttaagataatcagaattttcttaaccttttagccttactgttgaaaagccctgtgatcttgtacaaatcatttgcttcttggatagtaatttcttttactaaaatgtgggcttttgactagatgaatgtaaatgttcttctagctctgatatcctttattctttatattttctaacagattctgtgtagtgggatgagcagagaacaaaaacaaaataatccagtgagaaaagcccgtaaataaactttcagaccagagatctattctctagcttattttaagctcaacttaaaaggaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccggtaagtaacctctcagctgcttggcctgttagttagcttctgagatgagtaaaagactttacaggaaacccatagaagacatttggcaaacaccaagtgctcatacaattatcttaaaatataatctttaagataaggaaagggtcacagtttggaatgagtttcagacggttataacatcaaagatacaaaacatgattgtgagtgaaagactttaaagggagcaatagtattttaataactaacaatccttacctctcaaaagaaagatttgcagagagatgagtcttagctgaaatcttgaaatcttatcttctgctaaggagaactaaaccctctccagtgagatgccttctgaatatgtgcccacaagaagttgtgtctaagtctggttctcttttttctttttcctccagacaagagggaagcctaaaaatggtcaaaattaatattaaattacaaacgccaaataaaattttcctctaatatatcagtttcatggcacagttagtatataattctttatggttcaaaattaaaaatgagcttttctaggggcttctctcagctgcctagtctaaggtgcagggagtttgagactcacagggtttaataagagaaaattctcagctagagcagctgaacttaaatagactaggcaagacagctggttataagactaaactacccagaatgcatgacattcatctgtggtggcagacgaaacattttttattatattatttcttgggtatgtatgacaactcttaattgtggcaactcaaactacaaacacaaacttcacagaaaatgtgaggattttacaattggctgttgtcatctatgaccttccctgggacttgggcacccggccatttcactctgactacatcatgtcaccaaacatctgatggtcttgccttttaattctctttttgaggactgagagggagggtagcatggtagttaagagtgcaggcttcccgcattcaaaatcggttgcttactagctgtgtggctttgagcaagttactcaccctctctgtgcttcaaggtccttgtctgcaaaatgtgaaaaatatttcctgcctcataaggttgccctaaggattaaatgaatgaatgggtatgatgcttagaacagtgattggcatccagtatgtgccctcgaggcctcttaattattactggcttgctcatagtgcatgttctttgtgggctaactctagcgtcaataaaaatgttaagactgagttgcagctgggcatggtggctcatgcctgtaatcccagcattctaggaggctgaggcaggaggatcgcttgagcccaggagttcgagaccagcctgggcaacatagtgtgatcttgtatctataaaaataaacaaaattagcttggtgtggtggcgcctgtagtccccagccacttggaggggtgaggtgagaggattgcttgagcccgggatgatccaggctgcagtgagccatgatcgtgccactgcactccagcctgggcgacagagtgagaccctgtctcacaacaacaacagcaacaaaaaggctgagctgcaccatgcttgacccagtttcttaaaattgttgtcaaagcttcattcactccatggtgctatagagcacaagattttatttggtgagatggtgctttcatgaattcccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatg

SEQ ID NO: 2838 - DNA, 3383 bp; single-stranded, linear
agaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttggtttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatataggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctttctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataaaaaaaaaaaaaaaaaaaaaaaaaaa

SEQ ID NO: 2839 - DNA, 143068 bp; single-stranded, linear; identical to SEQ ID NO: 2672

SEQ ID NO: 2840 - DNA, 152740 bp; single-stranded, linear
tctagagccaaggtcacggaagcccagagggcatcttgtggctcgggagtagctctctgctgtcttctcagctctgctgacaatacttgagattttcagatgtcaccaaccaccaagagagcttgatatgactgtatatagtatagtcataaagaacctgaacttgaccatatacttatgtcatgtggaaaatttctcatagcttcagatagattatatctggagtgaagaatcctgccacctatgtatctggcatagtgtgagtcctcataaatgcttactggtttgaagggcaacaaaatagtgaacagagtgaaaatccccactaagatcctgggtccagaaaaagatgggaaacctgtttagctcacccgtgagcccatagttaaaactctttagacaacaggttttttccgtttacagagaacaataatattgggtggtgagcatctgtgtgggggttggggtgggataggggatacggggagagtggagaaaaagggggcacagggttaatgtgaagtccaggatccccctctacatttaaagttggtttaagttggctttaattaatagcaactcttaagataatcagaattttcttaaccttttagccttactgttgaaaagccctgtgatcttgtacaaatcatttgcttcttggatagtaatttcttttactaaaatgtgggcttttgactagatgaatgtaaatgttcttctagctctgatatcctttattctttatattttctaacagattctgtgtagtgggatgagcagagaacaaaaacaaaataatccagtgagaaaagcccgtaaataaactttcagaccagagatctattctctagcttattttaagctcaacttaaaaggaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccggtaagtaacctctcagctgcttggcctgttagttagcttctgagatgagtaaaagactttacaggaaacccatagaagacatttggcaaacaccaagtgctcatacaattatcttaaaatataatctttaagataaggaaagggtcacagtttggaatgagtttcagacggttataacatcaaagatacaaaacatgattgtgagtgaaagactttaaagggagcaatagtattttaataactaacaatccttacctctcaaaagaaagatttgcagagagatgagtcttagctgaaatcttgaaatcttatcttctgctaaggagaactaaaccctctccagtgagatgccttctgaatatgtgcccacaagaagttgtgtctaagtctggttctcttttttctttttcctccagacaagagggaagcctaaaaatggtcaaaattaatattaaattacaaacgccaaataaaattttcctctaatatatcagtttcatggcacagttagtatataattctttatggttcaaaattaaaaatgagcttttctaggggcttctctcagctgcctagtctaaggtgcagggagtttgagactcacagggtttaataagagaaaattctcagctagagcagctgaacttaaatagactaggcaagacagctggttataagactaaactacccagaatgcatgacattcatctgtggtggcagacgaaacattttttattatattatttcttgggtatgtatgacaactcttaattgtggcaactcaaactacaaacacaaacttcacagaaaatgtgaggattttacaattggctgttgtcatctatgaccttccctgggacttgggcacccggccatttcactctgactacatcatgtcaccaaacatctgatggtcttgccttttaattctctttttgaggactgagagggagggtagcatggtagttaagagtgcaggcttcccgcattcaaaatcggttgcttactagctgtgtggctttgagcaagttactcaccctctctgtgcttcaaggtccttgtctgcaaaatgtgaaaaatatttcctgcctcataaggttgccctaaggattaaatgaatgaatgggtatgatgcttagaacagtgattggcatccagtatgtgccctcgaggcctcttaattattactggcttgctcatagtgcatgttctttgtgggctaactctagcgtcaataaaaatgttaagactgagttgcagctgggcatggtggctcatgcctgtaatcccagcattctaggaggctgaggcaggaggatcgcttgagcccaggagttcgagaccagcctgggcaacatagtgtgatcttgtatctataaaaataaacaaaattagcttggtgtggtggcgcctgtagtccccagccacttggaggggtgaggtgagaggattgcttgagcccgggatgatccaggctgcagtgagccatgatcgtgccactgcactccagcctgggcgacagagtgagaccctgtctcacaacaacaacagcaacaaaaaggctgagctgcaccatgcttgacccagtttcttaaaattgttgtcaaagcttcattcactccatggtgctatagagcacaagattttatttggtgagatggtgctttcatgaattcccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatgagaagagctgagacatccgttcccctacaagaaactctccccgggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttggtttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatataggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctttctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataaaaaaaaaaaaaaaaaaaaaaaaaaaaagcttcagtatgcaaattttcaatgacatgtgcctgtggattctgaaaattcacagatctgtctatccttagctgagactgaaggcatctacttcccaatgaccaaatcctggtgctgtggcgacactgagcaggaactccattagaatatcaatatcactctgcagacattccatgatgtaagctatgttttctcttgttgcaattacacttaatttaccaccagctgcttcaatgtcatgggctatcttgaaaaatgaagctcctttcgtagtcaaactggatgcaagacacagcaaatgagaagttactaaattgttggagtcctcatagctactgcctgctttaatgaacaaaccaattcttgatgcagggcatagttttccaaaggagaaatcataaaaccatttggaaatttgatgatctcaaggtcctgatgatgtggagccactcctatgggggtagctgtggctttaactttgggggcaactttgagggaataaagtctcaaaaagagggaataaagtctcaagattgttcgtgacccatagtaacttctggcttaaaggaccattcggcaagtttttaaatgtattttctataatttccatgtagttctttatattttctatttcttatttaaaacctctattttagctcgtttcctttgacactgctctggcagggaaaggggtggcactgcctcattactgccaggtaggggtagaagtccattatccacttggtctccattgatacccaaagtggggagaggctcctgttactgctggtgagggtgggagtccccccactaagtttctgctaatactgtcctggtggcttgctactattcccatgaagcctccactgatactacattacttttgggtggtggcaaatgtcctgcctctccactagccctcctgctctaaaacaacccgagtagggagtgggaaggaagctttgttactggtaggtgggagctgaagtccagacttgccacattgtcccactgatgctacagggaggaggaagcgggccacattactgcctgatagggatgaaagccccagctccctacctggccttcgctgataccagcctgctacaggagtgaagagagatttgaaggcctcaatatagcctgtcgagggtggaagtcttgctcccaatgggcctttagcagcatgggtgggtgtggggccatagctgtctctgtactgcttggctagagtggagtatttgaggtccaaaagttttctgtctttctagccctttggttagaaagagcagacttttgttggaagtatttttttgtgtttacctgttgtatttccaggttcctagcttctccagcacagtctgggatgtgtgagacacagagaaaatccagtgatgttactaccgtatggtttcttgggtcccaacgtctctagctaatctgctccaccttttggagttttcttatttgttttagatcagggatttagtcatatttaataggagaaatatggaaaaatacttctactctatcttcctggaagttcctgtttattttttatgtccttttcctctggctagaccgtaagagacttacgaaacaaacacttacacattctactaaactcaatgtccaaagtttgtgaacttcttgaatattgcttgttcatttccacccccagtcactgactgaatctccctgctgtctgtctacaatgccaatgagcttctggttaacttcttctcatgcatgcttaggcaacaacttcccagttttactacacttgcccatccctagttttgttgttgcttaatcccttggcctagtgccaccatactcctccagcagagcaaccaattcttacattataggacagcacatatccactaaaaacagttcatgccacaccaaccacatttccctttgtcaacaaaattacttgatagataattccaggaatgcctgatgaagctgattgacaacaagatatttggcagactctctgctgcctatacataccttagcatgtggaactcaagtaatgagaggtccatttaattggattgaattgggctggataggattggattgaatcctgtgggatggctaggctaaattagaaatgaagactagtttaacagcagtatccaaggatagttgactaatgagttaattttactctcaaagacagtctttagtagtaagctgtaatgcattatatcaaactattttccagtcaatgatttataagttacttgaataaggatgctaaagatgtgccttattgaaatggcaattagcacaaagttgggaatgaaatctaattagttaaataacagaatcacataaaaaaggacttgaataaatgtagcatcctaccatgttcctggatagaaagactgctatcgtaaagatattcattctcctcaggttaaattataaactcaatgcaattcaacaggattttaaaaaactagacaaagtgattccaagtttacgtggaaaataaaatgtgagggaccaaacaatatttgaaaaagaaagagaataaaatctcatccttccagataccacaatgtattataaagcaatagtaattaacatgagggcagaaatgagcaagcaagtgaacaaaataagacagatagtcacaggaaactcatatatttataggtgctttgcgtataatgaagatggtccttcaaatcagttgggaaaagatgggttattcaataaatggtgttgggtaaaattggttatacattggtgagaaataaagtgaaactcctactttgtatcatatgcaaaaaatagattccagacagatgaaatatttaaatgtaaaaaataaaattctaaaactactagaaaaaaaagaagaatatttttattcctttgaaatagaaaaggtcttactaagcaaaacacagaagtaataaatgaataaatgaagacaaatatgataaaaataagttaaaaatataagcaatctttctttgtttttttttcacctttcctagaaaaaaatatataggcaacttgttaagcaaggtagattacaagaaaatatttacaacatttgacaggccacagattattatccagcctcatctgataagaaaacttcaacataaagatatctgttttttttcttataaggttcctcaaagtgagccaatcacttcttaagctgaacaaaaaacaaaacagaagtgatcttttccaataatgaaaacaaacattgacagagcagctgtaggatcctttcaggcaaattatgaaaaggtgccctttctcagaaaccacagttaccattcagctttgtgaccagaggtttgactgtaccctagtccctactagcaacccaaccacataaccaacttcaaaggtcctgaatgactgtgttgtacttaatggcagatgatctatctcccatttttgtcctaaggattttccaagataatatatttctgcatttgttttgcttttacttcactccaaattgaaatctatttgtgggataagactaaagaaatgcttataggaaaattgatagcaccaaattcctatcttaaaaaatgaaaaaggtttcaaatcaatgacctcagcttttactttaagaaaatagaaaaagcaggataagctaaagccaaagtaaacagaagaaaggaaattataaagataagagcagaaatcaatgaatagaaaacaaaagaaaaaaatcaaaccaaacagctgattctttaagcagatctataaaattgataaaactctagccagattgatcaagtaaaaaagagagaagacacaaattaccagtattaagaatgagagaggcaatatcactacagatcctacagatataaaaagtataagggcatactttgaataattttatgactataaattaggcaacttagataaaacaaatttcttgaaagacacaaacaaccaaagctcacctaaaatactcacaaattgaatagtcttatagctattacaaaattgaggccaggcgcagtggctcaagcctttaatcccagcactttgggagggctaggaaggcggatcacgaggtcaggagtttgagaccagcctgactaacatggtgaaaccctgtctctactaaaagtacaaaaattagccaggcttggtggtgcgtgcctgtaatcccatctactcaggagactgaggcaggagaattgcttgaacctgggaggcaaagttgtggtgagccgagatcgcgccactgcacttcagcctgggcaacagaacaagactccgtctcaaaaaaaaaaaaaaaaaaaaaaattgaaattatagttaaaagtcttcccacaaagcaaactctagacccagatggcttcaatggtaaattctactggacaatcaaacaggaaacagtaataattctccacaatgtctttcataaaattgatgcggaggagatactctccaactcattctatgaaactagcattaccctgataccaaaatcatacagagacagtgtaggaaaacaacagatcagtatccttcatgaacataaatgaagtacaatgcagtcttatgcataaatcagagcttcattgttctacagataaggtaatgtaggattgttggttgcccctccaggtctgttaaattcacctccttccccagagagcatccttcttaaggacagggagcctcaatatgtcagtcctcacagcacctccctcagtcttcagcacttaccagctcatcaccacaaccgataccacattggataatttcatgaattactttagagcaaatgcaagagaaaaaatggatttttatataggagaagaaggaggaaattcttgtggatttggtacagaatagggccaagggaaaattacagatgtaaaaagaaaagtgtgtgaaatagtatccttagtgctcacaaatacaatgatttcattgtttttaaaaataaaaaatgacaaatgtctaatgcttggtggtaatgctttattgaatgtgtgttatacactggttcctcattcctgaagttagaaataataccttcctcttttcatttggttatgtttgctgaaacaaatcaaaggctgagattgaaacacatgctacttcaggtggatgaccttactactaagctcatcacaacagcacttacagctgaagaccccagagtcctacctaacttttgtcacaacccagattttggccatgtagttctgggccttaccattaaagcagacagaagtcagaggaatgactcctttccacttgaagtgagctgcaggcttctaggaaaggcaagatgcacatttccctcctgtggagcataaagcctttgtaattcaggacttaggacccatatggatttgaaatattatgacattggagctggagtggttggggacaacaccagtagtgttataggccatggaatgtcaaaagaacatggaaccctgttaaaatcattaaacatcaaaactctcccctcctctggtgatatggtttggctgtgtccccatccaaatctcatcttgaactcccatgtgttgtgggaggcacccagtgggaggtaattgaatcatgggggcaggtctttcccatgctgttttcacgatactgaataagtctcacaagatctgatggttttataaaggggagcttccctgcacaagctctcttctcttgtctgccaccatgtgagacatgcctttcaccttccgccatgattgtgaggcctccccaaccatgtggaacttttaagttcattaaacctcttccttttgtaaattgctcagtctcaaatatgtctttatcagcaacgtgaaaacagactatctgattttctgtgggatgtggattatgaccatggacagagcataactgggacagagctggaaaaaatattaattaggtgcttaaaaatatttgttagaactatcttcatgaatgagaatcaatcctgtttccatggtgattcaccaggcatcaattccaagcatccatgaatcagaaaagtcctatcttctcttagttatcatccaggactccaaggaaccataattagccaacctgttcacatttccttttcattcactagcctcgaagtttccaggggacagggactctgtcctattcatttctgtaaccttaccacctgacccagaatagctgttccctgaagatttggtggattataaatgtggatgtcttatttctttgaaagtgtgagcttcaggtactgatcacgttattccaattatcaatttagtatctttcttcaccattaaactgtgaaattcttgagggaagaacctatgactgatttatctctgtaaactcatgccaccagtattcaaaatcacacctagcacatagtaaacactcaatgtttgttgaatgactgaaggaatggatgaaaatgaacctccttgcttctgaccagtggatgagttgcttggccgtgttcctacagcctagagctcatcccctaaagcatctgaagttacccattagtgcaatggttcttgaacgctggtgttgatcagaatcatctggatgcccaggttctctgaaataagatagggtctaggcatttgtatttttaccaaggaggtgtgatggagtcagatgcaagaaggctagttgaagaaaccacatgagagtttagtgtagtgtattagaagactggtttggctctgtcgctagtggctacatcatcttgctcaagtcatgccagtctcaggacctcattcagtctcttcagctgtaatatgggtgggttgcaccacataaccagaaagatcccttccagctctacccacttacaacatggtcaaatttggtctgattttttaaatcgtagtacaatatatatgacataaaattcaccattttagccactttaaatgtacaattctgtagcattaactacattcacattgttgtgcaaccatcactaccgtctacttccagaactcttcatcttgcaaaactgaacctctgttgtcattagtcactaactattcctctccccccctccttctaggccctggcaatcaccattctactttctgtcgctatgaatttgactactctaggtaacttatataagtggaatcacagcatttgccctattatgactggtttagttgacttagcacaacctcctaaggctcaaccacattttagcatgtgtcagaattttctttgtttttaaggctgaataatattctgttgtatctgtaaataacatctttattcatttgtccatcaacagactgttgagttcctcccatcttttgactattgtgaaaaatgctgctatgaacctgagtgtacagacatctggttgagtactgctttcaattcattgtttatatggatcatatggtaattttatgtttaatttttttggaactgctacattgttttccacagtgtacatcattttacatttccatcagcaatgcacaaaggttccaatttctccacattcttaccaacattttttattttctgtttcttatttatttgtttatttattctgagacagagtctcactctgtcacctaggctggagtgcagcagggtgatctcagctcactgcaacctctgcctcccatgttcaagtgattctcctccctcagcctcccaagtaaatggaattacaggtgcccaccaccacgcccaggtaatttttgcattttttttagtagtgatgaggtttcaccatgttggtcaggctggtcttgaactcctgacctcaagtgatccacccgcctcagcctcccaaagtgctgggattacaggtatgaaccactgcacccaggccattttttgctttttagataatagtcatcctagtgggtatgaagtggtatttcattgtggttttgatttatatttccctaatgatcagtgatattgagcatctttcaagtgcttattggccattttcttctttggagaaatgtctatgcaagtcctttgctcattttttaatccagttgctttttgttattctttttgatttgaaagtgttctttatacctcttgtatactaatcccttatcagatatgatttataaatattttcttcttttccatggattgccctttttactctgttgatagtgttctttgatacaaaataatttttaatttgaatgaagcccaattaatctatttttgtttcttttgttgcctgtgcttttggtgtcctatccaagaaactgttgccaaatccaatgtcataaagctttttcccatgcttccttctaagagttttgtagttacagctcttgtatttaggtatttgactattttgagttaatttttgtacatcgtataaaataagaatccaatttttattttattttactttttgtatgtggatatccaatttccccaccaccattcattgaaaagactgtccttttcctatcgaatggtcttggcacccttgtaaaacataatttgaccatatatgtgagggtttatttctgggctctctattctattctattctattctattctattctattctattctattctattctattctattctattggtccctatgtctttctttattctagtaccaccattttgctcatcataactttgtagtaagttttgaagtcaggaatcgtaagacctccagctttgttcattttcaaggttgttttgattattcaaggtcccttgatagtccatatgaatttcaggatggatttttctatttctgcaaaaaaaaaaaaaaaaaaaaaaaaaatcattgaaatttttaaacagattgcattaaatctgtagattgttttgggtagtattgacatttaacaacattaaatcttccaatcaatgaactaggctatttttatttattttttctgtttctttgagctacttttgtagttttcagtgtataagtttttgctacctggttaggtatacttctaagtattttctactttttgatgctattgcacattgaatcgttttcttaatttggtggtagcggggattgtgcattgttagtacataaaaatgcaactcattttttgtgtgttgattttgtatcctgcagctttaacaaattcatgttagttctaacagacttattctatgaatcattagggttttctacataaaagatcatgtcacctacaaacagagataattttactccaccccttcccgttgcaatgccttttatgtctttttcttgcctaattgttctggctaagacttccactaccatgttgaatagaagtggtgaaagtagacatccttgtcttgttccaatcttagagccaaagctttcagtctttcacggcctgaaagactttgtaatatgttctcaaggttaaagaacttcagaagttttctaagcaagagaccattttattaacttagttggcagcaattctgagagattagaatgaaaagatagaggataagaagtatctggcaggtataatatattgagtgtgctgaatatacttttagttttgtataggtgttaaaaaatggcaaaggaggccgggcgtggtggctcacgcctgtaatcccagcactttgggaggccgaggcgggcagatcatgaggtcaggagatcgagaccatcctggctaaaacagtgaaaccctatctctactaaaaatacaaaaaactcgctgggcatggtggtggacacctgtagtcccagctactcgggaggctgaggcaggagaatggtgtgaacctggaaggtggagcttgcagtgagccgagatcacgccactgcactccagcctgggcgacagagagagactccgtctcaaaagaaaaaaaaaatggcaaaggaaagaatgaaaaataaagcaaggtcccagaagaggccaaaaatcttaatcaaaattgactgaacattacggaatgaaatggtttttcctttactccaattaacgacttcacaagaagattccatcctcgtttataagattaacccaaaaccagcacttaaaaccagaagccttgaaaggatggagtttggggacccttctcatgtctattcccagaagggggtcttcttctggggtcctgtcccctaaagagctaggcaaaaagtatgcttgccacatctgttgaaagatagaaagttggtctaaaaatacatgagagggaactgaaacatttcagagaaggcaagactcagaagtaagaaaccaaaagaggaaggtaaaattctagttacaaagaaaagaggaatggaaattaaattgtcttacagagaaaatccagaactgccccctcttcccttactactccatcaaaaaaggggaaaaatagtcaatgggaaagttttgagaaaaatagatctctgcattcttctggttgagaattcagacaacttgaactagagagctgggtaatttcttgactaaaggtgtgttagatctgaaagggtttttcttaaaattgtctgtgttcatccctcccatcttagagaggaacacaggataagagacctctggagctcccccagggtcaccgagctaataggatcagagacaaagctacaaagtcattttctgacatctctccagggctctttttttctggaccccccatatcaacatgatgtatttattacattggattagcaactctccttgagctttcctcagtaccaggtttacatctcagtctgtgggtctcagagaaagtacccaatcagcagcaacattacctggaaactcatcagaagtgcccctcctcagccccaccccagatctatgcaatcagaaactctggaaatgcaggccagtcctaacaagcccaccagggaattctggtgcactaaggtttgagatccactgatcaaagaaataatattccttttcttcattataatagcatgaataataactaacatgtatttcacaatttacaaaagagctttatgctcttgttaaatttgagggtagtcttctcaaaatctctgtgaggctagaaagtcagatattgaaacacctgttttatgggttcaaagataggttcaaaagagagtaaatgattgttggggtggcaggtccagagagggcaggatcaaaactgcaattgagtcttctgccttataaaccagcatagcttccccaaggcacgtcacttctcgataaaatggtgacaactagagtgtcctttcagatcattcttagaagcatggagtgctaggtcaattgtgtaattgatgaggaaataataatactaagaactcccatcttctacgtccttatatacaatcctgtcaggtagaagctgagtctcagagagaacaagttgccctcccaggaccaccaggtaagctcggcatagctgtgcttagaatgtaggctgtctggcttctgggcttgcctgcccagggaggctttgtgggttctacttggtcatccagatcacagaggggcagcactgactcctacccagtgctcttgactgtacatctaatactttctactaagaaaaccccttctctttagaccaatggttttcaaatcttggtgtgcattggaatcacctggaaagcttgttaaaacacagattgtcccaccccaagagtttctgattctgtaggctggggtggggacccatgaaagtgcatttctaataaggtcccaagtgatgctgatgccaccagtgtgtggacaaccctttgagtggtgaagctctggacaccctaatttgcaaggctaatcaggcatatgtggcaaatgaatacgaactgaaattctgactccaatatcttcactgatattcctaatccatagcatacacacagtcccattcgtttcccttttagcttttaatctacatttatcctttcttcctctgccactgccttctctccagttagctcaaaccaggtaacacataaccgcctcctaactcatccgcccagttggtttctttggctttaatctagacttcttatctccaccagatttgccttaccaaagcaccaatttcttaaggcagggttagaattaaaaatcttctgttcctcctcattgcctaaaactcctaaacttatgattcaaggtcttccatgaccttcatggaccagtctaacgttttagcctgtcctaagtgacatgcctccaccacatacttcatgctttccactttctttctccatgtctttgttcatgcatttccatttcttctacctgcgatgtcctccttcgccatctctgtagatttaaaaatcctacagggctcatctcaaatgccctttccttcatgaagcctttcatgaaatccccatcgagaggttttccctcctctcagctctccaaagcacagatgtctgcgtttgtggctattatcttacgttgttttgtattaaaatttctccagctttacacatttgtcatcctcttaaggacaaacatcttattatggtcaatgtgaagctatagaggataatttaatgaaatattccaagggctagtcattacacatgactgatttatctctgtaaactcatccacactcatccacctgattttgattggccaagttaatgaatcagagaggaaaagatggtaaaaatataataaaaatctcctaggtagtctcacatcccacagagccccaggtaatgaaatgaggccctgagataatactttatgaacaataaaactccgggttctattgacagtgaagcaagacctgagagagaaggctaaattcccttgtgtctagctgccacaatcttctgagaataatggcctttcttcccgtctgccttctgaatcataggcaaatttttctctttggtgatccctaatacagaaaggggaagtcaaataaaatatatacaaggagaaggattctgggagacagagtttcttgattcccttctgcatgctcctcctcaaaagcctttatgagcttaccttacatttaaattcttttaaacaaggcattatgtggtctggtcttttccagctccacacaccttcacactacattccccccagctaattctgctctgggaacactgaccttcttttagttctttgaacacattgatttctggtcaagatgactcagtaacttcaacctttgttgtgcccttggtgctgtgaagatatagatatatattaaccactgcacaccagaaatcagaaatagcacaacagagaataaagtcattgagccatcttctgagctccaaaagacaaattttctccaaaaagacaaattcaggctctaaaacaataccttaaggaaccagaagtggaatagaaaattaaggtggtaagcagggctaaaccacatgcctgttgagcccaggtttggaagaagacaatggcaggtaggaatgtggtttctgatgggtaataggtactgttttcatttactttctgttgcttataacagaatatctgaaactgggtgctttataaagaaaaggaatttatgtcttgcagttagggaaactgagaagtcaaaagttgagggctgcaattgacaagtgccttcttgctggtggggatactctgaagagtcttgaggtggtatcgggcataccactctcagtgaggggactgagcatactaggtcaggtctttcttcctccttttataaagctatcagtcccactcttatgataacccattaatccattaactgattagccaattaatccatgaatggattaattcattcatgagggcagagccttcctgacccaaacacctcttaaagactccacctctcaatactgccacatgggggattaaatttcagcatgagtttttgatgagacaaatattccaatgatagcagttattaaaagtacatgcttgagagaaggggattggagtcagcctcagtgcttaaactcaaaagctaggatgaggctctaacactcctgaaagaaggagttgctgctggctccttaccagggctatatcttttacagagcaggagacctaaagaggcaggaggacccggacatcgtttggaaaccaagcactaaaacaggccatctgttatacccccaatatcctctcaggacaagtgttttgaaccactcacacaaggactagtctgggcaagtgggctagatgaagaaaccacaaaatagctaagtggggagagaaagaccaaaaatactattttattcaaaatgaaaatacaatccaaaattccatgattcatgaagaaatcaaatggtatgtgttaggtggttcttgcattgctatagagaaatacctgagattgggtaatttataaagaaaagaagtttaattggctcataattctgcaggcttcacaggaagcatggtgctggcatctgctcagcttctggagaggccccaagaagatttgctcaaggcagaaggttaagggagagctggcacatcacatggtgagaaaggaagctagagagagagtgcagggtgaggtgccacaagttaccacagccagatctcttgagaactcacttactttcatgaggacagcaccaagccataaggtgtagggagccaaagtcccatgggacatgaccaactcagcattccactggaggctatatgatcaaacagcaaactgtttatcacgaatgcaggatgtgagcaaactcacaactggtcctgccaacagaaggtttgttggaggcaatcactccctggtgcctgaggtaatctactgcaacatctagagaatgcagtcttgcaagcctactctggacagggcagctggcaccttattccatcccccttctcactatctttttttgcctaataaatacagagggctgtgtaaagctcagggcccttgtccactagaggcaagttgccccctgaccccttcttccaaatatactcttttgtctcttgtcttttattctcacatttgccccctttgttcagttccactaggtccgtgcgggttatatactggtgccctgagcagcaacagaatcaggctctcaacaagtgtcatccgaacatgggactttgaggacatgaacgaagaaggtctgctggagcagaggaacagaaattgacaaggtgaacagggaccctgggacgagtctgccagcagcggatataaggtcagttacctaaagaggtactgatcagtgccctaaagagatactgggagcagtgctttaaagaagtactgggaatgggaaattttctgaatcagggtaacaaggggaagaatttgtctattaaagaaaaacattatgtgcagttgcttaaagttgtattggaacagtctggagcttaggttaatttgcagacactaactatcacatgcgtccgtgtgaagagagtccaccaacaggctttgtgtgggcaataaagctttttaatcaccttggtgcaggtgggctgagtccaaaaaaggagtcagcaaagggagatagaggtggggcagttttataggatttgggtaggtagtggaaagttacagttaaaagtggttatctcttgtgggcagaggcaggggtcacaaggtgctgggtggggaaatcatgagactctttttctgggacaggagtgtcacaaggtcaattgatcagttggggtggggcaggaacaaatcgcaatggtggaatgtcatcacttaaggcaggaactgactatttcacttcttttgtggttcttcagttgtttcgggccatctggatgtatagtgcagctcacaggggatatgatggcttaggttgggctcagagacctgacattcctatctttttatattaataagaaaaacaaaacaaaatagtggttaagtgttggggcagcaaaaattttttggggtggtatgtagagataaggggcaatgtttctcagggctgcttcaagcacgatcacggtggtgtgggaatctagagtgggagagattaagctgaagaaaaattttggggaaaggggtgatattctggggttgttagaaggagcatttgtcatatagaatgatgatggcctggatgtggttttgtatgaattgagaaactaaacggaagacacaaggtccaaataagagaaggagaaaaacaggcattaaaggattaagaattgggaggacacaggacatccaattagagagtgcccaagggggtccagtgtaattatttgcctggacaatgagttttggggctctattaggttgtcatataccaggccagattgatttaggtaaaaacaacactcttcatttaaaatatacagagtcctccttttttagcagtgagtaagttgagacctattcctgtcttcttatattaataagtaaaataaagcaaaatagaggtgaagtgttggtgtcatgaggggaacaggaagcagttcggtcctatttgcaaattgattttgggggggtaaagaaaactagtgtacctttgcctgtccaattaataagtagacacatgtagatggaggagccacagaggaagaagagaactttgtaaggcaaaactggaaatgtaaagggaaaagatgagagggagcaccaaaagaggtgtcttgcacccagactcagggatctagtgagagcagcagctgttagaggttgtaatggggattaatggggctactgggtagagggggaggttcaacttttatggtgtatgagaaagcgcatagtgtctacaagcaacctttcattgctattcataggattgggtataagtaaacaagaagggggggctaggaggagagtctgaagaacaaggggaaggtagccaaggatggagtgaaatgtagggcaaatgtcttaaaggaaatgagaggttctaagaggagggctagtggcttgtaacccacatggaagaggttacgaaaggatgatagaatggaatgagcctgtgaggctggaaggaggaattttccttggtccaagaaccatttgccttgtgtgggaagagtttgataggtggaagtttcagtgggagggtaggcgggagtgactgatgagaaggagaaaaactggccataagggacagaagttggaatgctagctgctcctttagctaccttatcagcataagctttgccctgagtgatgggatctgatgccttttgatggcgcttgcagtgaatgaccctagcttccttggaagtagagcagctttaagaagagtttttatgaagaaggcattaataatggaggaccctcgtatagtgaggaaacctctttcaggccatataacagaatggaggtggagaatatggaaggcatatttagagtcagtataaatactgacacacaatccttttgcaagagtgagggctcgagttaaggcaatgagttcggcttgctgagagggagtggagtggggcagagtggtagcctcaatgatagatgtgaaagatactatagcgtagcctgcctttgctggtgagtggtgattaggcctagtggaactgccatcaataaaccaagtgtgatcagagtgaggaacaggaaagaaggaaatatgggaaaatggagtgaatgctaggtggatcagagagatacagtcatggggatcaggtgtggtatcaggaataatgtgggaggccagattgaagtccaggccaggaacaatggtaattgtgggagactcaacaaagagtgagttcaactgaaggagccgggggagggggagagcggcagaaagtatatgcatcaggtgtgaggaagaaaatacattttgaaagttatgagaactgtagagagtgagttgatcatagtttgtgattttgagggcctttaaaagtattaaagcagtggcagctgccacacacagacatgagagccagcctaaaacagtaaggtcaatctgtttagacagaaaggctgcagggcactgtccaagctcttgtgtaaggattctgaccgcacagccttgtactttggctgtgtgtaatgaaaagggttgggatgagttagggagagctagtgtgggagtagcttctagggctgtttttaaggaacataaagaggagtggggaaaggatttaggatctatggggtcagctaggtttccttttgtgagtttatgtaatggtttagtcaggatggcaaaaccaggtatccaaaggtgaaagtacccaaccatgtctaggaaggaaaggatttgttgctttgtagaagggattggggtttgggagattagccggacacagatcaggagggagagcacttgtatttttatgaagaattatgccgataggtaacggatgaggaagaaatttgggctttggagggggatacacgatattcccttgagaatagatgttggaggagcaggagggtgtcctgttgggaagattcataggaggggctataaagtagaaggccatcaaaatattgaataaggtgacaagcagatggacagaaaagtaaattatgagaaagggcttgactgaagtaatggaggctgtccctgaagccttgtggcagtacagcccaggtaagttgctgagactgatgggtgtcagggtcagtccaagtgtaagtgaagagaggctggggtgaagagtgcaaaggaatagtaaagaaagcatcttcaagatccagaacagaataatgggttgtggagggaggtattgaggataggagagtatatgggtttggcaccacagagtggataggcaagacaatttggttgataagctgaagatcctggacaggctttagtcccttcaaagcctgttgtgggatgggatactggcattgagcaggataagggtaattaggttttaatgggatggtagggttgcgtgatcggtcaccaaggagggagtagaggtatcccatacttgtgggttaagatagggagtcaggaggggaggttgtgaaggaggctttgaactggggaaaagggtggcaatgaggtgtggctgtagcccaggaatagtcagggaagcagataatttagttaaaatgtctcaatttaataagggagctgggcaggtgggaataactaaaaaggagtgcataaaagaatgttgtccaagttggcaccagagttggggagttttaagaggtttagcagcctgaccatcaataaccacaacagttatggaggcaagggaaacaggcccttgaaaggaaagtaatatggagtgggtagcctccatattgattaagaaagggacagacttaccctccactgtaagagttacccaaagtgtctgtgatgatccaggaggcttctgaggtgatcaggcagtgtcagtcttcagctgctaagctgagaagatctgggaaggagtcagtcagagagccctgggccagagttccaggggctctgggagtggctgacgggcaagttggacagtccgatttccaatgcggtcccacacagatgggatacagtttaggaggaatcctgggctgtaggcattccttggcccagtggccagatttctagcacttgaagcaagatcctggaggaatgcctgaccacagtggtttaggtgttttgaagttcttgtgtgctggagatgtggctgaggtttttctcacagcagaggcaagtaattgcaactcagaaatacattgccacttggctgtctcttctctattattgtacaccttgaaggtgaggttaattaagtcctgttgtggggtttgagggccataatctaatttttgaagcttttttaatgttgggagtggattgggtaataaaatgcatattgagagtaagacagccttctggcccctctgaacctagggcagtaaaatgtctaagagttgttgccaaagggaccatggactgggctgcgttttcatatttgatgaaaaaaaaagagcctaaatgctaactaatttgggagaggtcagataaagtaaaaggaacattaatcttgactatgccttcagctcttgccacctctctaagaggaaattgttgggcaagtggaggagtgctagtcgtggaatgaaaccataagctggactgggtgtgaggaggggaggtgatagaaggattacagcgtaggggagtagaggctgaggaagaattgggacctggctcagcctggtgaggagtggcctggtgaggagcagcctggggaggaggagagaggttagatgggttcgtagaaaagaaggattcaaaggactcggagcttggtgaggagactgaaggaacagacaggagagaaagaagaaagatttgggacaagtcgcattgggagcagagactaggaagggagtgatgtgtaaagaatgcctggacatcaggcacctcagaccatttgcccattttatgacaaaaattatctaagtcttgtagggtggagaaatcaaaagtgccattttctggccatttggaacaattatcgagtttgtattggggccaaatggtgttgcagaagaaaataagatgcttaggttttaggtcaggtgagagttgaagaggttttaggttttttagaacacaggctaaggcagaagaaggaggaatggagggtggaaggctgcccataataaaaaggtaagtttagagaaaagagaggatagagacacagagagagggggtggtggtactcatcagccaggggaggtggtacttgccaccaaggtgatggatcaaggcagtcatccccacggtgatcagacacctctgaaatgtgggtgaataatcaggcaggtgtccctgcagtgattagacaccaaggggagactgtcttcccgagtccgtgaccggtgctggagttttgagttcacagataaaacacatctcctctgtctctaccagaaagggaaaggaactgaaattaaggaagggagagattgaagggtggagagatagcaagagagttggaaaagagaataaaaagaggccacttactcaatttaaaattggtgagatgttccttgggctgatctgaggacccaaggttgtaggtggatctcctcacggaatgagggtgaggacaggggactggtctccagaaggagttcccgagtcctggatcttcagcaccaaatgtcatgtgcatccatgtgaagagagtccaccaacaggctttgtgttatcaataaagctttttaatcaccttggtgcaggtgggctgagtctgaaaaaggagtcagcaaagagagataggggtgggtcagttttataagatttgggtaggtagtggaaagttacagttagaggtggttatctcttgagggcagaggtgggggtcacaaggtgctgggtggggaaatcctgagacttatcatccagggaaggagtgtcacaaggtcgattgatcagttggggtggggcaggaacaaatcgcatggtggaatgtcatcagttaaggcaggaactcactatttcacttcttttgtggttcttcagtttcttcaggccatctggatgtacacgtgaaggttacggggatatatgatggcttagcttgggctcagaggcctgacactaacctcctgcagaagccacaaaaggttattacacataaaccatggtttccacaggcaggcactcttgatgtggaaaattgggatagagcaggattaaaacaagctcatcaaaaaggtcttaaagttgattcttcagttttctccacttggagtttagttcatactgtacttctgccattatctccttattattctgcggaacagcaggctgaatctaaaaattggaaagaatttgttgtcctactcacagctccaattgaatataaaaaacaggagagggaggataaaaattggcctataccgcctcctccagatgcagaaacatctgtaccatctccttcagtggcagaaatagagatcccagtacaaagaattttatgctctgctgtcatagctggagagcccttaggaccttgtgcttttcctatttctgtaaggcctgatccaaataatccacagcagtttattcatgaacactctccactagaatttaagttgttgaaggaattaaaaactagtgtggtcaataatggagtacaaagccaatggttcctggaggaaggaatgctagacatagaactttgggagcaagtggggagaaatcttaaacaacaccaggcacaaaggcatcaggtcccagtaaaatcttttatgttaggggctttgagtagagcagccctggttgttacacacaaaagagcctaaaaagggaaaggaggaggaaatgtcacctgccttatcacctccccttccctcagtgccaatatcactgggccaaaataacaaagaggaaatggaggtcttacctaagcttcctcctccaatagataggaagaaggacagaggatacgctacagctatcagtccctgtcttaagcaggcagcattagaaggagagctcttagccgggtgcagtggctcatgcctataatcccagcactttgggaggccgaggcaggcagatcatgaggtcaggagatccagaccatcctagctaacatggtgaaaccccgtctccactaaaaatacaaaaaattagccaggcatgttggtgggcacctgtagccccagctacttgggaggctgaggcaggagaatggcatgaacccaggaggtggagcttggagctttcagtgacctgagattgcaccactgcactacagcctgggcaacagagcaagactccatctaaaaaaagaagaagaaggagagctcttaacctgctcagtaatgcaaaatcggcaaggcaatcaggtgtatgtttataaaaagataagaaaaaggcattagaagccaaaaccacgtggccaagcaggcagtgggcaggagaaaatgctcagaggcagaaaagctcacagcgacaaagccaacaaggtctgcccaggacggcagcatccctctggcaaaggagcaagggagcagcacagacacaggcaaagcctaaacaagtacaatgtggccacctcccaggacctgcaccactgccctctggctctgtgggcagcccattgcaaaatttcatgtgttacatctcaggctatgattctctgctaagatgtaagtaaaatgtaagaatttgaaaagcatcttttctaataatggccactattgtcatctctctcctatccctgatgtagctttccaaattcaatttaagtaaaacagtaacctttgaagggaaagagattacagagggcccatgaattagttgaagagtaattaaaagctaggcatgtaaaaccacacattacgctttaaagaagaaatttaaacctaattaaatgatatttgttaaattagaaggtaaaaatgttgtgccctgttgggaacaggcccccaaatctggccataaactggccccaaaacaggccataaacaaaatctctgcagcaccatgacatgtttgtgatggccatgatgcccaccttgaaggttgttggtttactggaatgagggcaaggaacacctggcccacccagggcagaaaattccttaaaggcattcccaaaccactaatgatagcatgagcaatctgtgccttaaggacatgttcctgctgcagacagctagccagagcccatccctttgttttggcccatccctttgtttcccataaggaatgctttcagttaatctatgatctatagaaacgatgcttatcactggcttgctgtcaataaatatgggagtaaaactctgttcagggctttcagctcagaaagccataagccccctgatttcccacttcccaccctttatttctgtgtgtgtgtcttgaattcctctagcgcctctgggttatggtctccacaaccacgctggtcttggcagtgcccttctcagaaagtgaaaaagagttgtatgtaagtgtagtgaaaacataagcatgaatcactgtcttaacccactgattagatagtctttgatttgtacttgctaaaagagtcctaaattgagttcctcagctagtgagtcactgttttcaagactgtttgccagattgaagtccataaacttggtcagcccgaaaactcaattacaagatctaagctattctgcctgtggctttaagcacatggttaaagtatattatttaagtctctccttctagatatgctttcagattttctttttaaacttcttgttacttatttcagctttccatattgataattaatgcagtcaattgctcagttatgactgtgatatcatcaggattcctttaagtaaaaggcaattcaaagcggtattgcactcccccatacctaatgctttaacactgtttactgatgggtctggtaaacatggaaaagctgcagtctagtagagaccacataattcaatcactcgatctgagttcactagcactcagagagctaaggttactctgtttatttattaaagaatttttacaaccttaagctcactctggactttccagccttatgtggcaaatgtagccatcaatttatggggtcaagacttacttacagcatgggatatgaggcttacaaatgagactttgataacccaggattttaaatgttgaagaacacgggatatcagagtgaaaaaggtttagggaaaattctgacaagggaaaattctaacctgatatcaataactggaaagacaggttaaaccctgcaaggggatacattgacattttttcttcctcacttgctcttttctgctgtctgaatatgggcatgagggcaagagtcattttagaccaccaagtgaccttgaggatagaagccttatactagaggtggtgggaaagaaaaaacagaaggactcataaagaaaaaaataataaacctcagtattaagatggaaaaattcccccaattggtctataggttgaacttcatctctattaaatttcagctatgtttttgcagaatttgatatgctgatcataaaatttatatgaaaatgcaagagacacagaatagtcaaaactttgaaaagaagaaagttggaggacttacacttgttgattttaaggctttttacaaagctataataatcaagacaatgtgttactgacataatgatagacatattgatcaatatagacaatggatgaatggagtagaattgacagtctagaaataaaaccttatatatatggtcaatttatttctttatgtattctgtcatccagaatacataaagaacaccttcaactcaataacaacaataccaacaagggtgccaagaccaatcaatggaggaaataatagtcttttcaagaaattttgctgagacaactaagtatttatatgcaaaataatgagtttgaatggctaccatatacaaaaattaactcaaatggactatattaggtcagtgcaacagtaattgcagtttaccaccattacttgttttttttttttggtttttttttttgagacagagtcttgctctgtcacccagaccagagtgcagtggcatgatctcagctcactgcaagctccacttcctgagttcacgccattctccttcctcagcctcctgagtagctgggactacaggcatctgggtaatttttttgtatttttagtggagatggagtttcaccatgttagccaggatggtctcaatctcttgacctcgtgatctgcccacctcagcctcccaaagtgctgggattacaggcatgagccaccacgcctggcctaccattacttttaatggcaaaaatgcagttacttttgcaccaccctaatagaactaaatgtaagagctaaaactacaaaactgttagaagaaagcataggagcaaatcttaatgacatgagagttggcaattgttttttagatatgacaccaaaagcatcaaggacaaaagaaaaaaatggataaattggacttcctccaaattaagagaacttttgtcctgcaagcaatactattaagaaagtgaaaagacaagtcacaaaatgggagaacatttttgcacataatatatttaataataggctgacatccagaatacataaatacctacaactcaataccaaaaagacagcccaatttaaaaatgggccaaggatatgaataaacatttctctaaagaagatacaaaaatggtcaatatgcacatgaaaagatgctcaatatcaatatctattaggaaaatacaaattaaaacacaaaatataaaacacaagatatcaatttacactcaccaggatggctgttatcaaaaagacagataacaagtattggcaaggatttggggaaattgtaaccttcatacattgctggtaggaatataaaatttgcagcaggtttggaaaacagtttagcagtttctcaaaaagcctgggcatggtggctcatgcctacaatcccagtgctttagggagctgaggtgagaggattgcttgagcccaggagttggagaccagcctgagtaacacagtgagacctcttttctaccaaaaagaagagagttaaacatagggtaccatataagccagcaatccatctcctagatatgtacccaagaaagttgaaaacatatactgacacaaaaacttacatatgaatcttcatattagccttataataatagccaaaaagtagaaacaacccaaatacccatcaactaattaaaatatggtgtatctatacatattatttggccataaaaggaagtactgatacatgtcataacacaaatgaaccttggaagcactatgatctctgtattagtcagctcttgtattgctataaagaactacctgagactgggtaacttataaagaaaaaggcttaattgagtcacagttccacaggctgcacagggatcatggcccaggagacctcaggaaacacagttatgatggaaggaagagagtgaaggaggaggtgctacatacttttaaaccaccagatcttgtgagaagtcactcactatcatgagaacagcaagggagaagtccacccccatgatccagtcagccccagccaggccccaactccaatattggggattacaattccacatgagatttgggtggggacactaatccaaacaatatcattctgccccagcccctcccaaatcctgtgtccttctcacattggaagatacaatcatcccttctcaacagtttcatttcagtattaactcaaaaatccaaagtctcatctgagacaagacaagtcccttccacctatgagcctataagatcaaaaagaagttagttacttccaagatacaatggaggtacaggcattgggcaaatatatccattccaaaagggaaaaattagccaaaacaaaggggccacaggccccacgcaagtccaaaatcaagcagggaaatcattaaatcttaaagcttcaaaatgatatcctttgactccatgtctcacatccaggccacaccaatgcaaggagtgtgctcccaaggccttgggcagctctaccctgttgctctacagggtatagcccccatggctgctttcacaggctggcattgagtgcctccagcttttccaggtacacagtgcaagctgttagtggatctaccattctagggtctggaagattgtggccctcttctcatagctccagtagacagtgccccagtggggaatctgtatgggggctgcaaccccacatttctcctctgcactgcccaatagaggttctccatgagggctccattcctgtagcatacttctacctggacatccaggtgttttcatacatcctctaaaatctaggtaggggctcccaagccttaactcttgccctctgcacatccgcaggcttaataccacatggaaaccaccaatgcttatggcttgcaccctatgaagcagtagtctgagacatatctgggcccttttggccatggctgggatgcagggaacagtgtcctgaagtggcacagggcagcggggccatgggcctggcccatgaaaccttctttcctcctaggcctccagacctgtgatgggagggtctgcctcgacggtctctagaatgtgtttgaggcatattcctcattgtcttggctattaatatttggctcctctttacttatgcaaatttctacagcctgattaattcctttccaaaaaaatggggttttcttttctactacatggtcaggtcacaaattttccaaacttttacgcttccctttgaaatgtaagttccagttgcaggtcatttctttgatcacaaatataagcatatatttgtagaatcagccaggccacatcttgaatgttttgctgcttagaaactgcttccaccagataccctaaatcattgctatcaggttcaaaattctacatatctctagggcaagggcacaatgcctccaagacctttgctaatgcataagaaaattgacctttgctccagttcccaataagttccccatcttcatctgaggtctccttagcctggacttcattgtccatatcagtatcagcattttcatcacaataatttaactagtctctaagaagttccaaactttcccttatcttcctatcttcttctgagccctccaaactgctccaacctctgcccattacccgggttccaaagctgcttccacattttcggtatctttatagcaatgctccattcctgataccaattttctgtattagtctcttctcgcactcctgtaaagaactacctgagactgggtaatttataaagaaaagaggtttaattgactcacagttccacaagctgtataggaagcatggttcagaaggccacaggaaacttacaatcatggaggaaggcgaagagaaagaaggcacgtcttacgtggctggagtaggaggaagagagtgaagggggaggtgttacacacttttaaacaaccagatcttgtgagaactcactcactatcatgagaacagcaagggagaggtctgcctccatgatccaatcacctcctaccaggctcctcctccaacattggggattatgatttgacatgagatttgggtagggacacaactccaaaccatatcaatcccatttatatgaaatgtccacaatagataaatctatagagacataaaatagattggtgcttgcctagtgctggacgtgacaggagggtgtgagtaaaagaggcaatggagtgataggtacagggtttctttttggggtgatgaaaatattataaaattagattgtggttatagttgtataactcttgaatatcctaaaaatatattgaattttccatttccattttaaatgggtgaatcttatggtatgtgaattatatctcaataaaactgcaaaaaatgcacaatttgcaattgcaaaaatatggaaccagtccaaatgcccatcaatgagtggataaaggaactgtggtatatatatatatatatatatatatatatatatatatatatatatatatatatatacacacacacacacaccatggaatactactcagccataaaagggaataaaacaatggcattctcagcaacctggatggaattggagaccattattctaagtgaaataactcagtaatggaaaaccgaatatcatacattctcactcataagtgggagctaagctatgaggatgcaaaggcataagaatgatataatggactttgggaactcagggaaagggtgagagaggggtgaggaataaaaggctacccattgggtacagtgtacactgttcaagtgatggctgcaccaaaatctcagaaatcaccactaaagaacttatttacataaccaaataccacctgtttctcaaaaacctattgaaattaattaatttttaaaaactgctgaaatcaatagtgaaaggatggactattcaataatgacacagttaattgaatatcatattttaaaaattagatccttacctcacactataacataacaataaattccaggtgaattatagaccaaatatgaaaagcaaaattttaatattttagaagacaatttttatgaccttaagttagaaaatgatttttaaaaacaggatgcaaaaacactaatcataaagagatattttaggccaagcatggtggctcacacctgtaatcctagtactttgggaagctgaggcaggtggatcacttgaggtcaggagttcaagacaagcctggccaatagggtgaaacatgtctctactaaaaatacaaaaattagctggaaatcgctcgaacccaggaggcagaggttgcagtgagctgagattgtgccactgcactccagcctgggtgacagagagagactccacctcaaaaaaataaataaataaaaataaagagagattttaataaggtgcattaaaataaaaaactatccatcaaagacaccatgaataaagttaaaataggccacaatgagaatatatttgccatgaattttttctttttttttgagatggagtcttgctctgtcacccaggctggagtgcagtggtgcaatctcggcttactgcaaacttcacctcccaggttcaagcaattctcctgcctcagcctcctgagtagctgggattacaggtgtgtgccaccatgcctggctaatttttgtattttttgtagacacggggtttcaccatgttggtcaggctgagctcaaacccctgacctcgtgatccaccttcctcagcctcccaaagtgctgggattacaggcatgagccaccgtgcctggcctaccatgaatatttttttaaaggtagcatccagaattaataatcttctccaacaaatttcattagtagtcagggaactgcaaattaaaatcaaagtaaaatactactttccactcattagactaaaatccattcaagtctgataatacctagtactgagttggagtaatagaaactgctaatgggacagttagttggtcatcactttggagagaaattagtcagtatctagtaaaagttagtgatacaccttccattttcatctgttctgtgctgctaccaaagaatacctgagactaggtaatttataaataatagaaatgtatttctaatggttctagaggctgagaagtccaagattgaagggccagcctctgcagagagccttcttgctgtgtcatgccatggcagaagggcaaagagagggcaagagagagcaaaagcaaattcacagcatcaatcccttttataatcagcattactctattaatgagggcaagaccctcatggcctaatcacctctaaaaggtcacacctcttaatactattgcaatggtaattaagtttctaatacatactttttgggagacattttcaaactatagcacctaccctatagcccaacatttctactcctaggagtatgccctagagaaattctgcataaatatctaaagagaggccattgttgcattgttaggtactggaaaattggaatcaattactatgtctaccagcagcagaagatggctttttaaaagttttggtttattcatgaaatggaatattgcataaagtatgctccatctcaccagatgaaaacatttttcactaggactatttcaaaagtagtcttatcactgggcttctctattatgcataaaaattttaagtgaacatgttctttgacctagtactcctacttttaggaatttgcccaaaagggacaattatactactgggataaatctttgaatcataaagtaagttgtaaatggtacaagcagtatgtcttatttttatttaaagcacattaacaatattacacatatagtaaaaaataaataaataaaacatgtgaataataaacacccaatttagaacaagtgttgacagtggagagggaaagagagagaaagaaggagaaatggggagtgggagcgggtacacaaggaaattttagttgcagctccaaatttttactttttacacaatgaagcgaatatggcaaaataagatttgttaaagttgggcagcaggtacacagatattctatcattatcctttgaatatttctgtagatttaagttgtccattaaaaaaataaaatacacacataatttttaagattagttttttctatttcctggccttcgcatgcactgttaactttacctggaattctttatgcagtaattaagagcaaaggtgtagagcaagactgcttgagcttggatcccagcactgagttgatttagggagaataacttaatctcttaatcccaagagaaaatatgatataatagttttgagctcataaagttttcataagcattaaatgtgacctatatatgtaaagcaatctaacagtgcctatagtatttataagtgtctgcattaccaaattcatcattatcatggcatgtcatgtcaccatccactacattaccatcactgtcaccatcatcatcatcaccaccaccatcatcattaactccctttgtctagtcaattcatatttgttcttcgtattttagatacctgttaaaatattttttcaaagatgtctactctgattcttcagtacaaatttgatttaataagatcctatcattttgtccaaatacttataaaaatttgtagttctatatttaatgtgttttgtttgtttaacatctctctcctacattgtgttaagttttttaaagagaaggtaagggttaaagagagacatagagagagaaagagagacagagagagagagagagcggttctacagcaatacaggtatattagaaaaacctgcaaaggtggggaccagcttaatgccagagccccccactgcttataggctggggtacttataggtctgggggtacttataggcctgggtgggtggggtctgagcagtatggcttgctgcccaagaagatgttgataagacgttcccatgatgaggcagtttggtccttgcttccatagagtgtgatgcttcttgcactttttcccagcagaatgtggtagggatgttccttcaggtgggcctttgcctggcagggtatgataaggatgttcctgtgccttggaatcaggtagttagacaggatgtttctcacagcctgaacccccatggaatgtttcactttgaccagggtctgcgaaatagcagggggcttacaaaatggtgtagtttggactaacaccttggaacacaaaagtttcttggggccaaggctggcgtattagtctgttttcatgctgctagtaaagacatacctgagactgggtaatttataaagagaaaagaggtttaatggactcacaattccacatggctggaggcctcacaatcatgagggaggcaaaggaggagcaaaggcacgtcttacatggtggtaggcaagagaacgtgtgcaggggaactgccctttataaaaccatcagatcttgtgatacttattcactatcaaaagaacagcacgggaaaaatctgcctccatgattcaattacctcccaccagattcctcccatgacatgtggtaattatgggaactacaattcaagatgaaatttgggtggggacacagtcaaaccatatcagctgggtatgttttattcacctttttatacccattgtcatgtcttctggacaaacaatggatgtaaaatggtatagactcctgagtactcatttgttgaatgacaaatctatgaaccatttgaccagtatgcagcagccattaaaattatgtttatgaataatttacagcatggaaaaatttggggttgctagtagaaaaacaaaaaggtacaaaaggatatatataataagcctacaatgccatataaacaatactaacagcaaaaacaaacctataaattgggggaagatggggcagatagaagtaacctaaaatactaacatgttgttttggggtcatgaaattataaatgattatgcaccccttaatttttactttctatgtttgatttttctatggtaaatgcatttttattgaggtggaattcacataacatgaaatgaaaaatttagtggcatttattatattcacaatattgtacaaccactagctctacttccaaaacattttcatcactccaaaataaaaccttgtacccattaagcagttactccccattatttcctctcttagctcctagcaaccaccaacctgctttctgtctctagggatttatttattctggatattccataaaaatggaggcacaatatgtaccttttatgtctggcttctttcaccaagcatgtttttgaggctaatccacattgcagcatgtatcagtacttcatttctttttatgaataactgtatacagaccacaatttgttatccattttttggtttatggacatttgggttgtttccatctctcaactattgtgaatagtgctgctatgtatatttgtgtacaagaatttggttacctattttcaattcttttatgtatatatctaagatgaaattgcagggttatatgctaatcctatgtttagcatttttttttaggaaccattaaactgttttccaaatctgatgccccattttatattcctactagcaatgtaagcaagttccaatttctccatatcctcaacaacacttgttattttctatttttgttatagccattctaatgagtgtaaagtgatatatcattgtggttttctttgcattttccttatgaacattgatgttgagtaccttttcatgtactttttggtcatttatatatcatctttggagaaatgcctcttcgtgtatgttttgcccattttaaaactagattgtctttgttgttgacatgcatgcattctttaaatattctgcatactaggcccttatcagatatatgatttgcaaatgttttttctcattttactggctgtcttttcactttattgataatgtcctttgatgcccaaaagttgtttattttgatgaagcatatttatcaatttatttcttttattgctcatgcttttgatgtcacctctaagaatttataaccaaatcagaggtaatgaaggtttacccctctattttcttctaagagttttatagttttgactcatttacttaggtcgctgattcatttttagttaatttttgcatatgatgtgaggaagaggtccaactttactcatttgcatgtggatattcagctgtgccagcaccatttgtgaagagtctatcatctcctcatttaataatagtattgacacctttgttgaaagtcaattgataataaatgtatgagtttatttctggaatctaaattctattccattgatctacatgtctatccttgtatcagtatcacactatcttgattactgtagatttgtagtaagttttgaaactagaaagtgtgagtactgcaatattcttctttttcttttttaaagattgtcagggcctcttgcaatttaatagggatatgaggattgacttttctattctacaaaattaaaattttgttagagattgcattgacactgtaggtagctttcagtaacattgccatctcaacaattttaagtattctaatacatgaatatgagctttctttctctttatttaggtcttctttaatttctttcagcagtgttttgtagttttggggtacaagtctttcacctttaaattttggtgaaatttattcctaggtattgcatttttttatgctattgtaaataaaattattttctcaatttcctgttggatgttcattgcaggtgtatagaaactcaactgattctttgtgttgatcttatgctgagaccagctcagttggggagaccctaacctagaagcactagaggaattaaagacacaaacacagaaatatagaggtgtaaagtgggaaatcaggcgtctcacagccttcagagctgagagcttcaaacagagatttacccacatatttattaacagcaagccagtcattagcattgtttctatagatattagattaactaaaagtatcccttatgggaaacgaagggaagggctgaaataaagggatgggttgggctagttatctgcagcaggagcatgtccttaagtcatagatcactcatgctattgtttgtggtttaagaatgcctttaagcggttttctgccctgtgtgggacaggtgttccttgccctcattccggtaagcccacaaccttccagcgtgggcattatggccatcatgaacatgtcacggtgctgcagcggtttttatggccagttttggggccagtttatggccagattttggggggcctgttcccaacaatcttataccttgcaattttgctgaatttgcttgttaactttgatagtttttttgaggattatttgggattttctacatatcatgtcatctgtgaataaagatagttttgcttctttctttctcatttggatgccttttatttccttttcttgcctaatttccctggctagaacttccagtatgatgttgaataaccatggtgaaatgggcattcttgtctttttcctgatgttagagagaaatttttcagtctttaaccattgagtataatgttagctgtgggttttttacaaatatcttttatcatgttgaggaagttccttcctactcctacttcttggagtgtttttgatataaagggtatttaatttgtcaaatgctttttctgtgtcagttgagattatcatgtgagattttttttccttcattctattagtgttgatgttacattggttgattttttatgttgtactacatttgcattctttatataaatttcacttggtcatggtgtataacccttttaatatgccattggatttagtttgctagtattttgtttagagtttttgcatctatattcataagcaatatcagtccacaggttttttgtggtttatttgtctggctttgctataatggtaatgctgtcttcttagaatgaatgagggagtgttttctcctctttcattttttaaacgtttgagaaggagtgatattaatttttctttaaatgtttggtagaacttaccagtgaagccgtctggttcttaacatttttctgtgttgggaggtttctgattaccaatttgatctctttaatttttacagatcttttcagattttctatttcttcttgagtaactttttagcaatttatgtattttagaaatttgttcatttaatctaggttatttaatttattggtgtgcattttttcatagtattatcttataatcttttaatttttgtaaagttgataatgtccccaccttacctgatcttagttatttgtgtcttctctgtattctttttgtcttcttcttctgtcttagcatagctaaaggtttgtcaactttgttgatcttttaaagagtcaacttttgctttcagcatgcattactttttaaatagaaatatatacacctaagttgcattacaaaggagttgtcctccacacacttattctttcccaccatcagaggtttatggtccccgcaaaagtcaccatcagttgggctcaactccaatcagtcatggtaggtcagggtccatctcattgtctccatcactcatgcccacccagggtaagtctaatcatgttcaccaatcagaacctctgccacatcagctctgtgggtttcctctcatgccatctgtaccaacaatgagcacagtctgggtttcctgatgttttctatagcatggtgcccctccctgggacacctcagaagccacaatgatattcattaaacttcttcctgcaagtactccctctattgctccttctactcaccaagcttagtgtcagggaatatgctggtggggagtatgaatcttagcttctcactcccagactcggctcccaacctgctgttgccaagtcttggggacatctataaatgccttctaaatacctgtcttggcctatccccagccacagattcctccctagagcaggctacctctgaggcatctatactgagatcttaatcacagagacatttaaaacatctaggctacaaaagaattcctactatagggttcaaatgaatttctttccgtcacttgagacagctttttagcaagtacatgtattaaagattctgatttccccttttttctcctacagtttgtttggcctaaaggtatgacatctaatctgctgcatttacactctaagtcaaaattaccattttgttcttttaatttctatttctaatcatacattcttgtctactcctggttcatctggagacaaagttgaacttagaagatggaggagaaattcttatctgccctctgctagttgacacttcctttccaagaatcatttgcagttgctgggctttcttgctgtgactctatgccctgttgtgttactttttcatttgtgacaaaaacagtggtaatagtttgcttcatttttattatgaagacttgaccaggataggtaggaacataattactgctttttctgtgggcatcatattggtccagatcatgtttaaccagaattgaagatgtaaaatcctagaactcactaatctattttagtaggtcacaggaagcatgcaaaccataaaaaccgcaatgaaccaaaagcatctgtgttgacaagaggcaagaatttctctattttctaaaggcactaactgaacaaatctattgcccattacttaggaaattgctaagggcatcgttaaagtacttcaggctgttgaaaaaccttttctgtcttcttgccccaccaccaattctctctagctatgctttctctcacatgttcttgccatccatggagtggcagagaggttctgagtacaactctaactttcagtttcaatggcctaatccccaactcaactgctgaccttgagtgtaaaaataaacaagatcttaaacatcttagggccagcattctgggtcttcttttgttatttggggagcataaactattctcatatcattggcttgcagaaaaattgagcttctcctcttccttgccccatgtcaccttgaggtgaccacagccctgccttctatgtaatcctgcttggtcagcaggcacatcagagctcagtggcttgtgacatactttccttcaagcctgctcgaagggccatactcatcattgagactgggaaccttagaaaccatgaacccagtgccaatgggtagatacagaattctcaaactcatgaaaaaacatcctttttaactctctccgtgtgcataaagaattctaagatgtactgatcaagattcccaattttctaactatctattaatatatggacgaggtaagaagaaagttgcaagaaaaaaatttgtttgacttgacggttgtgtggttatttgccacactcccccagatccactctgagtcccaggatgctgattttaggggctacattgcctagactgtccattattccctcttcccatctggttcagtcactgggaagcactggtaggaggtcagagtgggagaaggaggttaggatactttctgcccctgctgtcctactgctttgctgaacttctagcagtggctgagccatcaacctgcagctctcaattccagctgtctgtagcactcaagtggtattgtttattcttttgatccttctagctgttaaggaagaaaaaaataattttttcctcaatgctcataagttcttggaatggacccctgtaacaaaagacagattaacacgagaaaagtttattaacgtacatattttatacgtacataggagctatccagggaatgaataattcttaaaaaggtgactttgaattccagctcatatagcatcttcaacaaagttcagtaacattttagagatatgacaagacaaagaaaatgaactttgagcctctagggacagtgacttgtaggaaggcaaaaggaataaatggaggtaaaggctggttagtaatacttgttaatgaagattcctctggtgccatctccaggtccacaaggatttaaatttgtcttcagtggtgaacctttgttcaccctggcagaaggtgtggaggggggtgcagatccgttttgtctttgtaagtctatatcctgcttttagacaaataaagggagggaaaagagctttccttcatctgcttcttaattgccttcagctcaacaatccttatgcaaaagaggtacattttagggtgtcaaattctggtctcccacaaagcatagggatgacagaccacctcaccatccctgttgcttcttttaagcctgctcacccctccaaaaatattttcattctatactgtctcttcaaaatctcagcggagggtgccctctgttatcctgccctctgtgtcagtataagccaaaggtttgaatcctggctctgcaactatctacctctgtgcctctccttgtttatgaaattacagggctggagacaaagatcacaatgtgaagacaaaattggagagcggtcctaatcagccagagcaaaatttctggctcttgctcttccccatcctgggttgaatcataggaacaggtggcaagatgccagggtcaggagattccagaagtggcagcaagctcagtgttaccaggtcagggatgacctgtcttattattgaaatctcagagatatgctccaattccggcccagagacacattgagagacaactggggaacttgctatgttcctgaacaggcaatgagctgtcttccaagaaaaaacctgagacccttcaagtctcaggtcttacttagcacatataccaggtcttacacaggacacatggttacaactgactgaaatctgggctgggtgtaggagctcacacctgtaatcccagcccttcaggaggctgaggcaggcagattgcctgagcccaggagttcgagaccagcccgggcaacatgacaaaaccccatctctacaaaaaatagtcaggcatggtggcatgcacctgtagtctcagctacttgggaggctgagatgagaggattgcttgaggttgagactgcagtgaagcatgatcatgccaccgcactccagcctaggcaacagagcaagatcttgtcgcaaaagaaagcaaaaacacaacataacacaacaacaacaacaacaacaacaacagcaaaaaagccaacttcttgaaatctggaaaggacacctggactgccctgagcatttgattgttgttggctctagcagtggatgcatccttcaacctctggcactctgcagggctcagactgttctgttctgtttgttacctgtggagtgcctgccagaccctgctctagctgctttaggtccatttaccctcatagacccccagtcttgttattcatatttcatatttgggaaatggaaacttagaaacttgccaagtccacagcatgagatcctgcctccggtgtctgctggattccagaaagtgccaggggccaacttagatgacaccatgttctctgcacaatcttaggaatgctcctagtctgatgtccccattgcaaaatttacattatcttttaacaaaacgtctttccaaggaggggcatttaaaataactgaggttcttcttgctaaggacgttcctgacacaagagataatttagcatttccttttcattaaaaagtttgaaatcctgtaatttgtgataatgtggatgaacctagaggatgttaagtgaaataagccacacacagatagacaaataccacgtgatctcactcttatgtggaatttttttttaaataagttgcttagccgggcatgatggcacacacctgtaatcctagctactcaggaggctgaggtgggaggatggcttgaactcagaaggtggaggtagcagtgagctgagactgtgccagtgcactccggtctgggtgacagaatgaaacccaatttaaaaaaaaaaaaaaagttgctatcttagaaaaagacagtagagcagtggttaccagagactggggaggaaagagaggaggtgagaatgggcagcagttgatcaacgggtacaaagttaccatgagataggagaaacaagtgctggtgctctgctccaagtagggtgacggtagttaataatgaattctgtatatataaatagctagaagagagggttttcaatatcattattatttcaaaagaaatgataaatgtttcagaggatggatatgtaattaccctgatttgatcattgcacaatgtatacatgtagcaaaacatcacattgtgtcccataaatatatacaattattatgtgaattaaataaaaaaaaattttaaagtcttatctaaatgaaatttctaaccagattctgaatccatgataccactgaaaccagcacacatgatcgcagtaaaacctcattatacttcctccactatcaccaataccctttattctctggaacatgaaacattctgttgtgctcatatcatgcaaattatcactagtaggagagcagagagtggaaatgttccaggtataaagacccacaagataaagaagctcagagtcgttagaaacaggagcagatgtacagggtttgcctgactcacactcaaggttgcataagcaagatttcaaaattaatcctattctggagacctcaacccaatgtacaatgttcctgactggaaaagaagaactatatttttctgattttttttttcaaatctttaccattagttgccctgtatctccgccttcactttctgcaggaaactttatttcctacttctgcatgccaagtttctacctctagatctgtttggttcagttgctgagaagcctgacataccaggactgcctgagacaagccacaagctggtgagttgtaggcattttttccattactttctgattcataggctcaacgcacctcaaagctggaaatgccgggtctgggtacaccctggggaactgcaaagcctgcacacttgggggaaatgatcaagatgagaggcaggggtggggatggcatgtgcaccaggagatgttagagaaaccctgaggaagagcagcgtgcagcaggtgatgggggagagtgggcagcaagcgaggccaggacagccactctgctcagtcaccagtccacacacccaggggctcactctgcccctctgagcacccaaggacgttaaagagctggaactgttagtctaaatataggaccatccaagctctgaaccaaaatgtgtcccttgcctcaactcaggagatccacagaggcagaagtaaggaatttattttctgaaagatagatttctatcagttctgggtgacatgttctgacacttgaaatgacacctaggacagcacatttcaggcatcttgctcattgttcactgtagtagaagctacatgctagccagttgtaaaaatgaaattaagtaatgtgtgcacagcatttaacatagcatctgagcttcaggagcactcaattaatgaccacagttgtgattctttaggcagatgcatttttttccaactttgatcagaggtcttatttagcttctccagatttcaagaatctggctcagtgatatgaaatacaagacttgtgaaaagtgtcaattgcaagagaaatggaaggataaagtatacaggtgggtggaaaagaaattcacagtcactgccagaaaaaaaattcttgagaatcaagtcctgatgatgttagggcttatagttcttattataaagagttttatgtactcattcagtgaacatttattggtgcctcctttagccaggtactatcataagagctgaaaataaaagcataatccagtccttgatcttgaggaacatgctgtgtgtagcagataacataataagtgcttatctagatgcatgcagtgttatgtgataagagtaatatgacagaggatacagattaggcttcacagagaagggggatttgagcaggaggtattgaagggtgaatagaagctcaccaatcattttgggcagaggggcaaggacctgcaaaaccactgaagcatgaaggaaatggtgagtttagggaaaatgaagagaagatggctgtgactgaagcacaggatttgggattggagaagggactggaggtgaggctgagaagaggcaaactcagaaaagatgttgtgctgggcagtctggacattatctttgaagcccaccacatataagtcatagggctactggaggttttaagctaaaagtgactattcaatttcaacttaagagaagataggttgagagggaacatggcttgagatgagccatgagcaaaggaaagactacaacaaagccaggagtgaggagtgtgtgaagcaagaaagtgacagttgaaagcagtgcagaggggatgaatctgagaggcatctatgaggtggaactcaaatgacatgataataatacagggcatttctctgtgtcagatgctgtcctaagtccttactccattgatcttcacagcaactcagcatagttaatattttatgcataaagaaatcggcacttgaaggagtaattggccccagattacactgcctataaggattcaaatccaggtttgtttggctccaaaaactggctcctaattttcagaaggagaagcgacccagggcaatgcccaattttgcttcttaggcaatggaggaatccacaatcggaaggagttttcagcagtgccccatttggggtgggttgaatttgaggtccctgcatgatacccactttgctcacttcagtgcctaaaactgagtatggttcatagtaggtgttcaataagtgttgatgcagtgaatacatgcatggggagatatgcatcaggcaatgggaaattcaactctaaggcttaggggaaagctggagcttgaagacagagctttagaaaacagtagcatagaagggagtaggaaccatgagtttagacaatacaattcaggaagaactttgtagcaaggataaagaggcaaaaaattaaagaggtgagagctaagtgtggtgcctggggaatcttaaggtgtgggcacggggaggagatgccagcaaagaacatgaataaaaagcggtagcacagcccctcccatctggaagccaaaaagaattgtaaatggaggaagttagcagaaggatcaaatacttgaagagggtggaattggaataaaaccagggcatttgaaaaattgggttgtcactgcaatcttaacaagagaagttttggcaggatgatggaggcagaaagctgagagaatcatcagttagaacgtttttgacttcagagaacagaaaatgcagttcataatggctttaaaacaggggcttgtttttctcccagcaatttgagaggccaaggcgggtgcatcaggaggtcaagagaccgagaccatcctggccaacatggtgaatccccatctctactaaaaatacaaaaattagcggggcatggtggtgcacgcctatagtcccatctactcaggaggctgaggcaggagaatcacttgaacccaggaggtggaggttgcagtgagctgagatcatggccactgcactatagcctggagacacagcgagactccgtctccaaaaaaaaaaaaaaagaaggcagaaggtgaatagttcaagggtgggtttaggactcagtgataataggattctgcctggcttctcatggttctctaggtcttccattcatggcaccatgccctcactaggcatgctgccagagcaggaggggcaggtggagggttctcttgtgtctgtcttatcagggaagaagagctttctcagaagcccccagcagactcccttttcatattatggtccagcaatgagtcacagacctatgcaccacctgcaaaggagccagagaaaacaaacgcccagcgcttttagcctgaaaatgagaatctggtttgctggggaagataaagggtgtcggaaaatggctgttgggtaaatcattgatgtctgccactaggaatgaaaggcaaatcaggaactggcacacatgctttcagggagatggctgcaagggagagggcaaagactgggaagttgcttatgtggtgccagactatttggaagatcatggattgcggtgtttgtgttgtgtggtcatcattttgttctttgtttacagaacagagaaagtggattgaacaaggacgcatttccccagtacatccacaacatgctgtccacatctcgttctcggtttatcagaaataccaacgagagcggtgaagaagtcaccaccttttttgattatgattacggtgctccctgtcataaatttgacgtgaagcaaattggggcccaactcctgcctccgctctactcgctggtgttcatctttggttttgtgggcaacatgctggtcgtcctcatcttaataaactgcaaaaagctgaagtgcttgactgacatttacctgctcaacctggccatctctgatctgctttttcttattactctcccattgtgggctcactctgctgcaaatgagtgggtctttgggaatgcaatgtgcaaattattcacagggctgtatcacatcggttattttggcggaatcttcttcatcatcctcctgacaatcgatagatacctggctattgtccatgctgtgtttgctttaaaagccaggacggtcacctttggggtggtgacaagtgtgatcacctggttggtggctgtgtttgcttctgtcccaggaatcatctttactaaatgccagaaagaagattctgtttatgtctgtggcccttattttccacgaggatggaataatttccacacaataatgaggaacattttggggctggtcctgccgctgctcatcatggtcatctgctactcgggaatcctgaaaaccctgcttcggtgtcgaaacgagaagaagaggcatagggcagtgagagtcatcttcaccatcatgattgtttactttctcttctggactccctataacattgtcattctcctgaacaccttccaggaattcttcggcctgagtaactgtgaaagcaccagtcaactggaccaagccacgcaggtgacagagactcttgggatgactcactgctgcatcaatcccatcatctatgccttcgttggggagaagttcagaaggtatctctcggtgttcttccgaaagcacatcaccaagcgcttctgcaaacaatgtccagttttctacagggagacagtggatggagtgacttcaacaaacacgccttccactggggagcaggaagtctcggctggtttataaaacgaggagcagtttgattgttgtttataaagggagataacaatctgtatataacaacaaacttcaagggtttgttgaacaatagaaacctgtaaagcaggtgcccaggaacctcagggctgtgtgtactaatacagactatgtcacccaatgcatatccaacatgtgctcagggaataatccagaaaaactgtgggtagagactttgactctccagaaagctcatctcagctcctgaaaaatgcctcattaccttgtgctaatcctctttttctagtcttcataatttcttcactcaatctctgattctgtcaatgtcttgaaatcaagggccagctggaggtgaagaagagaatgtgacaggcacagatgaatgggagtgagggatagtggggtcagggctgagaggagaaggagggagacatgagcatggctgagcctggacaaagacaaaggtgagcaaagggctcacgcattcagccaggagatgatactggtccttagccccatctgccacgtgtatttaaccttgaagggttcaccaggtcagggagagtttgggaactgcaataacctgggagttttggtggagtccgatgattctcttttgcataagtgcatgacatatttttgctttattacagtttatctatggcacccatgcaccttacatttgaaatctatgaaatatcatgctccattgttcagatgcttcttaggccacatccccctgtctaaaaattcagaaaatttttgtttataaaagatgcattatctatgatatgctaatatatgtatatgcaatatatataggctcttgcttgatctctccaggaggtagtgattatgagaagggggtggagaatgatgagttccttcaccaggagcaaaggacggggatcgtgtggaaccactgcagaactatttccggaatcaactaagtggagagagccaggaaggctgcatcagaacccagtaaagcttcttgtctggatctgagctggtttgttttgtgcttgcttttccctgccttgccactcccctcactcttctcttttccccacagcctttttcacatagctcttggctgtaggattgccccactccaaaaaccagtgtgtggaggtccaggagtgagaccaggaaagaatgtgaaagtgactacacaaggactcctcgatggtcgtggaaaaggaaagtcaattggcagagcccctgaagccagtcttcaggacaaagaaggagcctagagacagaaatgacagatctctgctttggaaatcacacgtctggcttcacagatgtgtgattcacagtgtgaatcttggtgtctacgttaccaggcaggaaggctgagaggagagagactccagctgggttggaaaacagtattttccaaactaccttccagttcctcatttttgaatacaggcatagagttcagactttttttaaatagtaaaaataaaattaaagctgaaaactgcaacttgtaaatgtggtaaagagttagtttgagttactatcatgtcaaacgtgaaaatgctgtattagtcacagagataattctagctttgagcttaagaattttgagcaggtggtatgtttgggagactgctgagtcaacccaatagttgttgattggcaggagttggaagtgtgtgatctgtgggcacattagcctatgtgcatgcagcatctaagtaatgatgtcgtttgaatcacagtatacgctccatcgctgtcatctcagctggatctccattctctcaggcttgctgccaaaagccttttgtgttttgttttgtatcattatgaagtcatgcgtttaatcacattcgagtgtttcagtgcttcgcagatgtccttgatgctcatattgttccctattttgccagtgggaactcctaaatcaaattggcttctaatcaaagcttttaaaccctattggtaaagaatggaaggtggagaagctccctgaagtaagcaaagactttcctcttagtcgagccaagttaagaatgttcttatgttgcccagtgtgtttctgatctgatgcaagcaagaaacactgggcttctagaaccaggcaacttgggaactagactcccaagctggactatggctctactttcaggccacatggctaaagaaggtttcagaaagaagtggggacagagcagaactttcaccttcatatatttgtatgatcctaatgaatgcataaaatgttaagttgatggtgatgaaatgtaaatactgtttttaacaactatgatttggaaaataaatcaatgctataactatgttgataaaagatttaaaaacaactggctgtttttttacactgtggtgtggaagattgtgttgtgttcacaacttttcacttcttcccctgtgtgattacacacacctgcccttgtggtgtgacttgcagtgcgccctacaggccacacaaccccatgccctccaccactggctctgctgctggaatgtgagcagaagtgacatctgcctcatccaagcagagcctcttgctcagccacaggaaggcccattccagatcacacccgtcagcccgtgcgccctggtgaatgagaagacacagggagctgcagccacatataacatgagcaagaagtctgtgtttgctgtgataagccactgagttttaggggttgtttgttaagaagcacaaaaaccgattaagacatgtggtatatagtgacttcatatatagaatctggaaaactatccatttattttcaatcatggaattcaatatgacaagcatcccggagggtctacctatgccagactgggttggaaacagaaagacagatgttaatgccagtgtcctttacacctccaagtccagggccagctgtggagtgggaggggtagagaaggtcctgtgcacagtcacagtgcgctgtgcagagcaggaacagaggcatctgtgaaaagtgctgagagcctggaggacagagtgactaatgcaatgacagtcttgcatcataggaataacagccacagcaggattttattgctgccaaagaaactgccatttaaaaattgccagccatccgggaggctgaggcaggagaatggcatgaatccaggaggcggagcttgcagtgagccgagatcgggccactgcactccagcctgggcaacagagccagactccatctcaaaaaaaaaaaaaaatgccagccatctctctttctaaagtggaatcctcaagtctcgtttattctggggacatttgagtaggctgttcgagttaagcaggtggaagttgatgatccctcatcatcattctgagggatgagtgtctgaagactttttggtaaggaagggtcttggcatagcccaccccatgccacctcccttgatctgtgatatccccagcagctggggaggttggagcattttgcaaagaggccccgaagcctccagaaagtaaaccttcaagagcccatccttccttcctcttttgtttttgctcattatgaaaacttccctgacaaattgaaaaggcttcaggtgagattagcccacaggaaaaaccaccaagggccacccagaggggccacactgtgacagaaggagtatgggctggtgagctgacctctggaagacagtgcatgaattgaggagaagagattggttccaggcatgggaggaatgaggctggaaatttcttcagacattgccacttcggcactctgtgtgtgtgtgtgtgtgtgtgtgtgtgtgtgtgtgtgtgtgtgtgtgtgtgtaaacagagtcctgtaatgcaaggtccggccttggcagccccagcctggagccacagtgagatgtgagctgagggttatgctgggaaaaacctctccctcccagcacctgaaaggctctgcaggcccagcagctcagcaagcaagggtaagggcatggactaacatcttatttcatactatcccttataacacatcctaatgtaatcagctcacaatatgaaattatttcatttctctccagtcattgtttcaatggggccttagggttgactggattctggaggtccctgcctagaggagggggtgcattctgtccctatgtcccctcctgctccatcctccacagcacgtgcctagtggtctaccttgtggggaattcttgtacctccctcttctaggcatggactagcattgagaagtgggagaggagtgttaggaaaaagggcaaatatagacataccttgtcttattgtgctttacagatattgtttttgttgttgttgttgttgtttacaaattgaaggtttgtggcaaccctgcctcgagcaagtctattggtgctgtttttccaacagcatgtgcttgttttacatctctgtgtcacattttggtaattctcccaatatttcaaactttgtcattatttctatatctgttatggtaatctgtgatcagtgatctttgatgtcactattgtagttgttttggggcaccatgaagtgcacccatgtaagatggcaaacaatcaataaatgttgtgtgtgttctgactgctccatggactgcctgttcctgagacacaataatgtatatataacaattatatatatatatatttataacaattatatatatatatattttttttttttttttgaggcagagtcgcactctgattgcccaggctggagtgcaatgatgtgatttcagctcactgcaacctctgcctccccaggctcaggtgattctcccacttcagcctcccaagctgggactacaggtgtgcaccatcacacccggctaattttttttttgtatttttaggagagacagggttttgccatgttgcccaggctggccttaaactcctagactcaaacaatccacctgcctcagcttcccaaagggctgggattacaggcatgagccactgtgcccagcccaagacacaataatattgaaattaagccaattaataaccctacaatggcctctaagtgttcaagtgaagggaaaagtcccacgtctctcactttaaatcaaaatctagaaatgattaagcttagtaaggaggacatattgaaagtcaaggccaaaagctcacctctgcaccagttagccaaattgcgacttcacaggaaaagttcttgaaggatatttaagctctactccagggaacatgcaaatgaagagaaaacaaagcagccatattgctaatatggagaaagtttgagtggtctggagaaaagatccaaccagccacaacatttccttaagtcaaagcctaatccagagcaagactctaactctcttcaatgctatgaaggcggagagaggtgaggaagctgcagaagaaaagtttgaagctagcggaggttggtttgtgaggtttaatgaaagacaacatctccataacataaaaatgcaagatgaagcagcaagtgcaaagggagaagctgtggcaagttatccagaaaatctagataagataattgatgaaagtgtctacacgaaacaacagattttcagtgtagacaaaacagtcttatgttggaagaagatgccatccaggactttcacagctagagaggagatgtcaaggcaagctgcaaagctccacaggacaggctgactctctttttagaggtgaatgcagctgatgactttaagttgaagtaaatgttcatttactattttgtaaatcctggtgtcattaagaattatgcgaaatctactctatctgtgctccataaatggaacaataaagcctggatgacaacacatctgtttacagcatggtttactgaatatttcaagcccactattgagaactattgctcagaaaaaaagattcctttcaaaatattactgctctgcaccatgtcgatcaagagctgtgttggagatgtacgagaatattcatgttgttttcatccctgctaacacaaacatccattctgcagtccatggaccaagactttcaagtcttattaagaaatatatttcataaggctattaagaaatagctatatatatatatatatatagccttatatagtttatatagctaccattgatagtgattccattgatggatctgagcaaagcaaattgaaaagcttctggaaagtagtcattattctagatgccattaggaacatttgtaattcatgggaggaggtcaaaataccaacattaacaggagtgtgaaagacattgattccaacccccatagatgactttcaggggttcacgtcttcagtggaggaagttgctgtagatgtggtggaaacagcaagagaactagaactagaagtggagcctgaagttgtgactgaattgccgcactctcatgatcaaacttgaacagatgaagagttgcttcttacatatgagcagtgaaagtggtctcttgagatggaatctcctcctggtgaagatgctgtgaacacggttaaaatgacaacaatcgatttagaatattacataaatttagttaataaagcagtggcagggtttgagaggattgactccaattttgaaagaagtgggtaaaatgctatcaaatagcatcacatggtatggagaaatcttttgtgaagggaagagtcgaccaaggtggcaaattgcattgtcatcttattttaagaaattgccacagccacccccagctttagcaaccaccaccctgatcagtaagcagccatcaacatcaaaacaagaccgccatcctcttcagcaaaaacactatgacttgctgaaggctcagatgatggttagcatttttagcaatacaatatttttaattaaggtatgcacattggtttttctgacataatactattgcatacttaatagactacagtataggataaacacaacttttatatgcactgggaaaccaaaaaggttatttttgagatatttgctttactgtggtggtctgaagctgaactcacaatctcaccaaggtgtgcctgaacctctttagctaactggccactgccacagtccactctgtgttggtcaagatgccccagagtggcaggcacactgtgtggtcacatccaagggcctagatatggtgggggctccaaatggatctagatatgtgagatctctctttgatttgacttcttccaacccaccattttctgggtgctgggctcatctcacccagaaagtaggacccaatgtgacagttcctgcccagttccctcctgtggtagccacttgacccaggggcactcttgatccttgcagcctcacttacacaccctatctctacccctattaactctctccaatccccactccccctgctcagcttgtctgctgcccagtgggggccccacccatgctggcctctccttttgcaagtccccattcctcatatggtttcttcagagcccctttctttggctttgaggagagatgccctcactcgcttccccaccaatcctgcccacttctacaatccattcattatcctaattgcctccgtatacagactggagtgagaggagttgatgtgatgggtgtggatacagggctggtgctgtcatcttctagtaagccctgggagaggtgtctgagcccaggtgtcagtggttttctttggaactgtgagtgcataacacttctttgccttcagccttaggccatagttgctagttctgggacaaccagaaaagccctacataatctcgtgttatgtgcagagctgagtatagagctccaggtatgatctgactcacttaagatcacagtgagtctattgtattgttgaactgttagcttagacatctgttactgtacctacatggcactagcctcacgcctagacaccgatctgaaagaaatcccctaaatgcatagagaagacttctcagctgagctaaggggctcccaccaggtttgagcctatctaatgaatccatgaggtagacagcctgcacatgtccacttggtttgatgaattgcacaaatccctatgggggatgtggttcatgggctgggaagtgggttaccctgggaaaggtctacaggacagaggcagggatggagacaacagcatggtgagttcccaacccacccacgatgataggtgtctgaggcagaaggtaaagaggctgtcacctggtgggtgtcataagactcaagtgtcattgttgaggcacatgggtaacaaagcgtggcactggatgggggtagattcttcctatttctgtgaggatcagggggactccctggctctcctgctaaaggtggctctagggacaggaagagtgtacttcttgacagggatgtcagagcactgatggtgacaatcagtgtgacactgctcacatgactgaacaaccgagaagagcccgactgtctactgaacaacgggaagagcccgactgtcaatgacggagctctgttaaatatagttaaggctattttgttgaatgaatgaagccagacaggaaagaggacagtatctttaatccatttatagaagttaaagacaggcttatttaatctctatgaagacagagtggcccttacctctgggtggagcaaaaggcaccttctgaagtgatagggatgttccttatcatcttgatccggagtggtagttacatgcatgtatgcatatcaaaactcaccaagctgtaccactaagtgtgttcttcctcaataaaaataataaagaactacacttataaagaattttttaataatataggaaaatgtctacactataatctttagctaaaaaaaaaaaaaaagaagccgcctacagaatggtatatgcatgagaacaattaatcgaaaagtgcatgggaaaagtcaggattgaaacatcatgttttaaaagacattgttttgatactgtgagaatgtacctaagtttttccttttttctgtttttcccaattttatacaatgagcatgtgttggttttataattagacattttgtttgtttggtttggttttgagacacagcttgctgtcacccaggttggagtgcaatggcccaatcttggttcactgcaacctccatctcctgggttcaagagattctcccacttcagcctcctgagtagctgggactataggggcgcaccaccacatccagctaattttgtgtatttttagtagagatggggtttcaccatgctggccaggttggtctcaaactcctgacctcaagttatccactcgccttggcttcccaaagtgctgggattataggcatgagccaccgcacttggcctagacatttgtttttaaaaataaaagattcatttgctctttttacagcccgtctcactgttgactgatattgaccaggagtcaactcaggccccagggattttcacaacagctgctgtatggcagggtttctgctcactgtgctcatgtagttggcccttgcacccaaagtgaataattaacattctccccatcctgttgacgatgctctgaaaatatggtccagaaatggtgtgagcaaggagacagcaaagcaatgcttggaacataggtgcagtgactagacatggggcagctgtttaaagacaaaaaggccccaaaaaggagggatggcacgaaacaccctccaatatgggcatggagtctagagtgacaaagtgatcaaaagttcatttcctatggggtgtccgaatgtacttaataataaaaagagaacaagagccatgcaaactgagagggacaaagtagaaagagtagcagacaccaagcaactaagtcacagcatgataagctgctagcttgttgtcattattgtatccagaacaacatttcatttaaatgctgaagaatttcccatgggtccccactttcttgtgaatccttgggctgaacccccctgtcctgagtggttactagaacacacctctggaccagaaacacaaaagtggagtaacacacactgcaaagctgtgcttccttgtttcagcctgtgaatcctcaccttgtttcccatctagcctatatttttcaaactaacttggccatagaatcatgtagtatttagggtggaagctgccccaggtctagcacgtcatttaacagatgaggaaatggaagcttgggcagtggaagtatcttgccgaggtcacacagcaagtcagcagcacagcgtgtgtgactccgagcctgctccgctagcccacattgccctctgggggtgagtatgtcttcacatcctccaataccctaatgacagacaaacagaacatggcaaagcctcagctctgcatggtgaaagtaagaaccagcaattgccacaaacagaaatacagtgttggtccggcagcctccgggggttctgcacaagtggattaccagtgaatacaaggctatctatctttcgaaaaaccaacgttgtatttatgctattttctataaaattttatattaatttatttgttacctatttttgaactctttcaaaagcacactttatatttccctgcttaaacagtcccccgagggtgggtgcccaaaaggctctacacttgttatcattccctctccaccacaggcatattgagtaagtttgtatttgggtttttttaaaacctccactctacagttaagaaaactaaggcacagagcttcaataatttggtcagagccaagtagcagtaatgaagctggaggttaaacccagcagcatgactgcagttcttaatcaatgccttttgaattgcacatatgggatgaactagaacattttctcgatgattcgctgtccttgttatgattatgttactgagctctgttgtagcacagacatatgtccctatatggggcggggttgggggtgtcttgatcgctgggctatttctatactgttctggcttttcccaagcagtcatttctttctattctccaagcaccagcaattagctttaccttttcagcttctagtttgctgaaactaatctgctatagacagagactccggtgaaccaattttattaggatttgatcaaataaactctctctgacaaaggactgctgaaagagtaactaagagtttgatgtttactgagtgcatagtatgtgctagatgctggccgtggatgcctcatagaatcctcccaacaactcatgaaatgactactgtcattcagcccaatacccagacgagaaagctgagggtaagacaggtttcaagcttggcagtctgactacagaggccactggcttagcccctgggttagtctgcctctgtaggattgggggcacgtaattttgctgtttggggtctcatttgccttcttagagatcacaagccaaagctttttattctagagccaaggtcacggaagcccagagggcatcttgtggctcgggagtagctctctgctgtcttctcagctctgctgacaatacttgagattttcagatgtcaccaaccaccaagagagcttgatatgactgtatatagtatagtcataaagaacctgaacttgaccatatacttatgtcatgtggaaaatttctcatagcttcagatagattatatctggagtgaagaatcctgccacctatgtatctggcatagtgtgagtcctcataaatgcttactggtttgaagggcaacaaaatagtgaacagagtgaaaatccccactaagatcctgggtccagaaaaagatgggaaacctgtttagctcacccgtgagcccatagttaaaactctttagacaacaggttttttccgtttacagagaacaataatattgggtggtgagcatctgtgtgggggttggggtgggataggggatacggggagagtggagaaaaagggggcacagggttaatgtgaagtccaggatccccctctacatttaaagttggtttaagttggctttaattaatagcaactcttaagataatcagaattttcttaaccttttagccttactgttgaaaagccctgtgatcttgtacaaatcatttgcttcttggatagtaatttcttttactaaaatgtgggcttttgactagatgaatgtaaatgttcttctagctctgatatcctttattctttatattttctaacagattctgtgtagtgggatgagcagagaacaaaaacaaaataatccagtgagaaaagcccgtaaataaactttcagaccagagatctattctctagcttattttaagctcaacttaaaaggaagaactgttctctgattcttttcgccttcaatacacttaatgatttaactccaccctccttcaaaagaaacagcatttcctacttttatactgtctatatgattgatttgcacagctcatctggccagaagagctgagacatccgttcccctacaagaaactctccccggtaagtaacctctcagctgcttggcctgttagttagcttctgagatgagtaaaagactttacaggaaacccatagaagacatttggcaaacaccaagtgctcatacaattatcttaaaatataatctttaagataaggaaagggtcacagtttggaatgagtttcagacggttataacatcaaagatacaaaacatgattgtgagtgaaagactttaaagggagcaatagtattttaataactaacaatccttacctctcaaaagaaagatttgcagagagatgagtcttagctgaaatcttgaaatcttatcttctgctaaggagaactaaaccctctccagtgagatgccttctgaatatgtgcccacaagaagttgtgtctaagtctggttctcttttttctttttcctccagacaagagggaagcctaaaaatggtcaaaattaatattaaattacaaacgccaaataaaattttcctctaatatatcagtttcatggcacagttagtatataattctttatggttcaaaattaaaaatgagcttttctaggggcttctctcagctgcctagtctaaggtgcagggagtttgagactcacagggtttaataagagaaaattctcagctagagcagctgaacttaaatagactaggcaagacagctggttataagactaaactacccagaatgcatgacattcatctgtggtggcagacgaaacattttttattatattatttcttgggtatgtatgacaactcttaattgtggcaactcaaactacaaacacaaacttcacagaaaatgtgaggattttacaattggctgttgtcatctatgaccttccctgggacttgggcacccggccatttcactctgactacatcatgtcaccaaacatctgatggtcttgccttttaattctctttttgaggactgagagggagggtagcatggtagttaagagtgcaggcttcccgcattcaaaatcggttgcttactagctgtgtggctttgagcaagttactcaccctctctgtgcttcaaggtccttgtctgcaaaatgtgaaaaatatttcctgcctcataaggttgccctaaggattaaatgaatgaatgggtatgatgcttagaacagtgattggcatccagtatgtgccctcgaggcctcttaattattactggcttgctcatagtgcatgttctttgtgggctaactctagcgtcaataaaaatgttaagactgagttgcagctgggcatggtggctcatgcctgtaatcccagcattctaggaggctgaggcaggaggatcgcttgagcccaggagttcgagaccagcctgggcaacatagtgtgatcttgtatctataaaaataaacaaaattagcttggtgtggtggcgcctgtagtccccagccacttggaggggtgaggtgagaggattgcttgagcccgggatgatccaggctgcagtgagccatgatcgtgccactgcactccagcctgggcgacagagtgagaccctgtctcacaacaacaacagcaacaaaaaggctgagctgcaccatgcttgacccagtttcttaaaattgttgtcaaagcttcattcactccatggtgctatagagcacaagattttatttggtgagatggtgctttcatgaattcccccaacagagccaagctctccatctagtggacagggaagctagcagcaaaccttcccttcactacaaaacttcattgcttggccaaaaagagagttaattcaatgtagacatctatgtaggcaattaaaaacctattgatgtataaaacagtttgcattcatggagggcaactaaatacattctaggactttataaaagatcactttttatttatgcacagggtggaacaagatggattatcaagtgtcaagtccaatctatgacatcaattattatacatcggagccctgccaaaaaatcaatgtgaagcaaatcgcagcccgcctcctgcctccgctctactcactggtgttcatctttggttttgtgggcaacatgctggtcatcctcatcctgataaactgcaaaaggctgaagagcatgactgacatctacctgctcaacctggccatctctgacctgtttttccttcttactgtccccttctgggctcactatgctgccgcccagtgggactttggaaatacaatgtgtcaactcttgacagggctctattttataggcttcttctctggaatcttcttcatcatcctcctgacaatcgataggtacctggctgtcgtccatgctgtgtttgctttaaaagccaggacggtcacctttggggtggtgacaagtgtgatcacttgggtggtggctgtgtttgcgtctctcccaggaatcatctttaccagatctcaaaaagaaggtcttcattacacctgcagctctcattttccatacagtcagtatcaattctggaagaatttccagacattaaagatagtcatcttggggctggtcctgccgctgcttgtcatggtcatctgctactcgggaatcctaaaaactctgcttcggtgtcgaaatgagaagaagaggcacagggctgtgaggcttatcttcaccatcatgattgtttattttctcttctgggctccctacaacattgtccttctcctgaacaccttccaggaattctttggcctgaataattgcagtagctctaacaggttggaccaagctatgcaggtgacagagactcttgggatgacgcactgctgcatcaaccccatcatctatgcctttgtcggggagaagttcagaaactacctcttagtcttcttccaaaagcacattgccaaacgcttctgcaaatgctgttctattttccagcaagaggctcccgagcgagcaagctcagtttacacccgatccactggggagcaggaaatatctgtgggcttgtgacacggactcaagtgggctggtgacccagtcagagttgtgcacatggcttagttttcatacacagcctgggctgggggtggggtgggagaggtcttttttaaaaggaagttactgttatagagggtctaagattcatccatttatttggcatctgtttaaagtagattagatcttttaagcccatcaattatagaaagccaaatcaaaatatgttgatgaaaaatagcaacctttttatctccccttcacatgcatcaagttattgacaaactctcccttcactccgaaagttccttatgtatatttaaaagaaagcctcagagaattgctgattcttgagtttagtgatctgaacagaaataccaaaattatttcagaaatgtacaactttttacctagtacaaggcaacatataggttgtaaatgtgtttaaaacaggtctttgtcttgctatggggagaaaagacatgaatatgattagtaaagaaatgacacttttcatgtgtgatttcccctccaaggtatggttaataagtttcactgacttagaaccaggcgagagacttgtggcctgggagagctggggaagcttcttaaatgagaaggaatttgagttggatcatctattgctggcaaagacagaagcctcactgcaagcactgcatgggcaagcttggctgtagaaggagacagagctggttgggaagacatggggaggaaggacaaggctagatcatgaagaaccttgacggcattgctccgtctaagtcatgagctgagcagggagatcctggttggtgttgcagaaggtttactctgtggccaaaggagggtcaggaaggatgagcatttagggcaaggagaccaccaacagccctcaggtcagggtgaggatggcctctgctaagctcaaggcgtgaggatgggaaggagggaggtattcgtaaggatgggaaggagggaggtattcgtgcagcatatgaggatgcagagtcagcagaactggggtggatttggtttggaagtgagggtcagagaggagtcagagagaatccctagtcttcaagcagattggagaaacccttgaaaagacatcaagcacagaaggaggaggaggaggtttaggtcaagaagaagatggattggtgtaaaaggatgggtctggtttgcagagcttgaacacagtctcacccagactccaggctgtctttcactgaatgcttctgacttcatagatttccttcccatcccagctgaaatactgaggggtctccaggaggagactagatttatgaatacacgaggtatgaggtctaggaacatacttcagctcacacatgagatctaggtgaggattgattacctagtagtcatttcatgggttgttgggaggattctatgaggcaaccacaggcagcatttagcacatactacacattcaataagcatcaaactcttagttactcattcagggatagcactgagcaaagcattgagcaaaggggtcccatagaggtgagggaagcctgaaaaactaagatgctgcctgcccagtgcacacaagtgtaggtatcattttctgcatttaaccgtcaataggcaaaggggggaagggacatattcatttggaaataagctgccttgagccttaaaacccacaaaagtacaatttaccagcctccgtatttcagactgaatgggggtggggggggcgccttaggtacttattccagatgccttctccagacaaaccagaagcaacagaaaaaatcgtctctccctccctttgaaatgaatataccccttagtgtttgggtatattcatttcaaagggagagagagaggtttttttctgttctttctcatatgattgtgcacatacttgagactgttttgaatttgggggatggctaaaaccatcatagtacaggtaaggtgagggaatagtaagtggtgagaactactcagggaatgaaggtgtcagaataataagaggtgctactgactttctcagcctctgaatatgaacggtgagcattgtggctgtcagcaggaagcaacgaagggaaatgtctttccttttgctcttaagttgtggagagtgcaacagtagcataggaccctaccctctgggccaagtcaaagacattctgacatcttagtatttgcatattcttatgtatgtgaaagttacaaattgcttgaaagaaaatatgcatctaataaaaaacaccttctaaaataattcattatattcttgctctttcagtcaagtgtacatttagagaatagcacataaaactgccagagcattttataagcagctgttttcttccttagtgtgtgtgcatgtgtgtgtgatgtatacaaagagagagataattgtatttttgtattttcttttaaataatttttaaaattgacccttttcctgagacaaattgccagaatagtttgtatttagagatggtacctctaagagtaaggttgctggttgctgagcaattgacttgaaaacttttaaaattcaaattttaattccactactcaaaagaattgccatgttttaaaaaagagaattggtgccataagttagttgtctatgtttgaaaatgaagaagatatgcaacgtcatggcctggtcacttacccgcagccctgagttgtaggcacatcatatgtgagaatgaggatgcttttctttcatttaaaatccctccccaaaacttggctctaattgcagtcatgacaatcatgtacatttggatttatgtgcacgagtctcttaccctgagagaggacaggtgctacaggtggaggggacccgtctgggtcacgttcacattttgaacatgctggttttcagtcactgcacactcatctcccagcgcaggtcatgggcagcagatgcaaaagctgcccgtggtcctatttggaggtgcatgaaatgagcagaagacagaatagcttgatctgactagaagggcagcttgtccctaccaagacttgaaggattgcctttcatctgttagggtaaaaggtagaatgaaccaaggaagggcaggagggggctggggttagggtagaaggaaggggccatggagaagggagatccatcccataggaggaaggcagtgcggcagggaggtttgaaggtatcagcttttgtggctgacatacatgcagtcatgtcaattgctcgtttttccttttccatcttattaaatgtcttccaatgttagcacgaagaaaagctatttgcagtgttgccagcctttccagagcccgtccccattacctccccaggcccatgcctttactccttggagtttcaactcacgaccttcaggatctgactttattcaccaactctggggtgaacgtaccttctgtctccacccagaggtctctatcaaagaggagattgcatgccatggataaagtcaaagtagaggtgactgtccttaggaagagtaatgtgaaaattcataaactgggattctgtttacattttgtactccaggggttcttagtttaaatcgctctgaataaattaagatgcaatggcatttcaactgttatgattaaatttacaaatcatttattttctatcacggggagagatagagctccaaatgcaaacataactgctcaagtgttaacacttataatgaaaacataagaattaccaccaactaccctgggggctagaagcagaaatgtgaaccagaaaacaaatcatgaactttcctttttttttttgagatggagtctcgctctgttgcccaggctggagtgcaatggtgcgatctcggctcactgcaaccactgcctcccgggttcaagcaattctcctgcctcagcctcctgagtagctgggactacaggcatgcaccaccacgcctgggtaattttttgtatttttagtagagacagggtttcaccgtattagccaggatgctctcgatctcctgacctcgtgatctgcccgcctcggcctcccaccgaagtgctgggattacaggcatgagccactgtgcccggccaacaaatcatgaactttctaactgcagttccttgtagcttgttaacacatccacttacttattgtcagagtacgtggagattttccacaaccctcggggataaggctgaacagaagaggcaaaaacgtgaaaacatttcgatagctcctatactttgaaataaaattcactgtaaaagttgcttgtatttttccaaaacagagtcaacccttaatatttaagattctgtatacaaatacatatttttatataattaatatatattgtcatatgacatatatctttatattaatatgcatgcatataatatatatttccttcctaattttctataagcaattttacaagactgacttctatttgcctccttattgttactacgtggtttgataatccgttttgtgtcattgtgattctgtcatgttttggggacttatttttgtttctctgggtggtcactagtttttttaaagcattcatggaagagtgtgaatcttttacaagctaggaagccatggcaagccttgggtcatactgcccccgcgaggccacattggcaaaccagcaagggtgttcaacttccagacttggccatggagaagacatacgaggaggcttttcacattcagctctttaatgtttgtctctgccggcaccatcccagttgtgaataagaggtatttccacagcggctcagggtaggtagtgcacagctcacattcatcatttctgaaaaccgagaggagtctccattcggggtacaggttgatgcctgtcgtggaatgaaggttccaacacccagaccaatctctgcagtgtgctgctctcatgagcttgcaacaagatcagaaaatgttttgtgactaagcatttttcatattgcataaaatgcttcaagctcctcccttgtttctctctataatcctgtatatctgatgattgtgggtaccaagtgtttgaaataatcaaatgtgatttgatgttggtaaatttctttttttttttttttttacttctattttttttattatactttaagttttagggtacatgtgcacattgtgcaggttagttacatatgtatacatgtgccatgctggtgcactgcacccactaactcgtcatctagcattaggtatatctcccaatgctatccctcccccctccccccaccccaccacagtccccaaagtgtgatattccccttcctatgtccatgtgatctcattgttcaattcccacctatgagtgagaatatgcggtgtttggttttttgttcttgcgatagtttactgagaatgatggtttccaatttcatccatgtccctacaaaggacatgaacatagcaaagacttggaaccaacccaaatgtccaacaatgatagactggattaagaaaatgtggcacatatacaccatggtaaatttctttatcattcgcactctcctttctctattattgttattgtaactgaaccgcagattagtcactcattgcttgcagaatccaattaacaagagcgaggtcagatataaagaaaatgatttattccaaacctccttcagggaagaggtgcagcctcctgcctctaaatgcactgcttcgccaggcgtggtggctcacacctgtaatcccagcactttgggagaccgaggagggcagatcacttaaggtcaggagttcaagaccggcctggccaatatagtgaaacccctgcctctactaaaaatacaaaaaattagccagacgtggtggcgggtgcttgtaatcccagctactcgggaggctgaggcaggagaatcgcttgaacctgggaggtggaagttgcagtgagctgacatctagccactgcactccagcctgggtgacagagtgagactctgtctcaaaataaataaataaataaataaataaataaatagtaaatgcactgctttgcttttggagcagaaagcaggcactttgaaaaggcaggggaggaagtgagcaagggcagggggtctgcacactggcatggtgcctgatctatccaggcagttgaattggcactttcataggcagaaataagttgaaaaagtggcctaaaactctctaggtgggagtggatagtgggcatgccttcaacctgcctttctggagggtgagttccatggcaaccccctgaagggtgagagttccatggagatcatgctttggtctgtaaatcagctgttaactctctagaaagttctgtcttggagcatatagttagatgaacttgccctgtaaagaatgtctggtgaaggggaagtaaaaggtgagatttgcatttctaaagggctaagtagaacgtggggtacaagaggaaaggagaaaagagaaaataatttaaaaaataattgtaacttattcccttttacttagaaaaaagggaatactcagttacattatcacctcgtttacatcaaaccctcttatggaatcctatggtttgaaaacaaaaaggttgttgaggaccagtgagcccaacccctttgctttataaatgaagagcattgcctgccctaagccccagagactctgatgtcgtgggtctggagtgggctccaacagcggcatgttttgatggtgcttcccagtggcacgccagcgatgagcctttgagtagggaaagtaggagcactcgtgactcccttcacgatcagcacctgtgtgctaataaattcacaaaagccaacatattggagtcactcagggagttttacaaatagtgaggttaaatccaacctcaaatagttctgattcgatctgcctgcattgctgccctgtggttccccactgtagaagctccccaggtgattctaagtgtagccaagtctgagaaatactgcctaaagcctgttggactgacagcaagggctgttgtctgagcaagactttgcctggcctggggtggcatgtgcaccaggaagagtctcaactttcataacagaacattccccaagctggtttttttaaagcatgtgaatctagacttcattggcaataccaaagatctgtatttgaggctccaagtatttcactttcatttttggttttgggttatgttttcacccttcctttccaagtgaaaagtaaacagaagtgggatgtctggcgcccatgctgagcttggcaacttcaaattcaatagagaagaagtctcttgtatagaaaagggcctgtctgagatgtttctcaaataaatatagattttgcttatgtggctaaaggattcttctccccccatttccttatccctgcagtgagccatccttcttaactctttccatgaaagcattattcctgaagaactgggaactcatgccagccctgatcaggcaatgataattctgcagagaattagaatttagatttaaattgtcaactcttatacatcctggcatatggtttaaacacatgtacacacacacaaacacctcctactatttactgaagagcagatatctgataacttaatctttttggttttgagtcaagacaattcctccttttgaaactgcataccgctgaatataataaaatgtaattaagattaaaaataagaaactaatgggagaatttcaatattgtctctgttcactttaaaattcctctacttaggtttactgccattaccaaagactattcaaaaatcctttttaggagaatcctaatggtttcctgacatataatcaaataaggactctgttgattggctaactcaatcttcctgtgccaaaaagcagagcccagcagagaagagggcagggacttgaaagtcagactgactcgagttccagccttggggctgtgggagcttgggcaagtgacttaacgtctctggctctcaggatctaaaaggatttccagtagtaatttggggtgttactgatacaggagctaaaaagaaattatttaggtggttagtgagggtcagagagtcctcggtaagatttgccttttaacaaaaagcagccccaaaatcatttgtttgctaacaaagagaagcctgtaaaattgagctgcagacatagataagcaagctggaagcttgcacgggtgaatgccggcagctgtgccaataggaaaaggctatctgggggccaggcatgttcaacatggattctccatcttcccttttctttgtcaaccaagtgtacagtaaaggaacaggcaacatggcacgggccaggtagagaacccttctgcataataaaagattagggtgagatggccagcttcttcccgtgctatgtaaatggcatacctggtccaaccagtcttttgggccctgtgtaaatcagacaccgcctcctcaagttagtctataaaaccccatgcattttaccgtgaaactgggagatccactcggaaccccctcctgcacgagagaccttttctcttttgcctattacacttccgctcttaaactcactgctcatgtgttagcatccttgatttccttggcatgaggcaatgaaccttgtgtattaccccatacaaatgatgctgcttcattactaatagcaacctgacagggttgtgttggggtataaattatctagaccagggagatccaatataatttttttgtaatgacgggaatgctttgtatctgcatcatccaaaatggtagccaccaggccagggtgaaatgtggccagtgtgactgaggaactgaatgttttccatgatttaatttaaatgtggccaatggctactgtaggagacagtgtgagtctggcatattataaataataaatattaatataatttgaactttggcatcagtgtttcctagatttgaattactatgcaagttgcttactgtttccaagcctcagctttctaatctgtaattggggctaataatagtatctgccttacaggtttgttcagaggataaatgagaaattgcatgttgagggcttaacacagtgcctggcacataaaagctctggtaacagttagccactttaataatttgctaataatggctatttcttcttcagattaggatgtgctcccccaaacagtgcacttagacatagcgggcaatccagctcactctctgcagtgagagagaagcactggccgaccagagtcagccaggggctcatgggtatgaaatcaacagcatgattttgtaagtaatggatggaaagggcctcacaactttatggcactgtgttcaatttgcttggtcttctgtagctccttttgaaagccttttagggtggattaacctgctaccaataattctggtcagatgtagactccatagctcaaagcaaactgagagagtgagggcagcaggccaattccccaccccttccttctggactctgacagaagcttacactcaaggaagagcaagtaggaattaacgtgttaagagctaggtaagcaaaacccaatgagaagttctggcaaagccccatgggcaggggtggcttaggcacaggaaacaagtaggatttcataccacgcgcctcagtctacttccggggccctcatcctcagctgtgcctatgcaaaggagagcaaccaataaaccccaccgccactctcctactgtggaggccagggatggccaggggtaagagagggatgggaagtgtttcctccagccgtcctctgagaaggagaggaaactgggcagagcttctgtcctccttcaagcagaaacagaaacaaaagaaacccctaagggggttcttacttcccctctagttcagttgtgcactaaccatctgcagctcaacattcagcattcattcattgattcagcaaacattgaaggagggccagctatgtgccagatgccaactcatgccatgaaagagagtccctgtccttatgaaattcactatttagagagaaaagcaagcaaaaaggcaaagtttgaaaagtactgttgaagtggcatcattgtctggggtgaatacctgaggtttgtggtctcacgccaagggaatcaaggactcaggcacacaagaagtgagtttaagagcagaggtttaataggcaaaagaaagagaaaaaagaatagctctcttgcctgcacagagagaggggcacctgagtggatcttcctgttttgtggtgaaatgcaaggcattttatagacgagcttgaggaagtggtgtctgatttacttaggacccgagagattggtcagaccaggtgtgatgtttacatagcatacaaagaagctggccatcccatcctaatcttttattacgcagacggggtctatacctggctggtgccatgttgtctgttccttactgtacacgtggttgacaaagaaaagggaagatgaagaatccatgttgaacatgcctggcccccagatagtcttttcctattggcacagctgccggcattcactcttgcaagcttccagattgcttatctatgtctgcagcccaattttacaggttgctctttgctagaaaagaaatgatttgggggctgcttttcattaaaaggaaaaccttaccaaggttaaaaagaaaaaaatttctttttaatgcctatgttactgtgaacagtgtcgggataaggctctgagagccagatgaggatgagttatccaatccaaggatgggggtctggaggaaaaaatcctagagagcattgctgcagttgaataaggattagttagaagctactgagtggagcataggagtaggaactcttatgcaaatgtgcagaggtgaaataaagcaaggtatagtccaggtgcctaaagtagcacagctgacttgagatagatgatagataggtagatagatggatagggtacatagatgatagatagatagatagatagatagatagatagatagatagatagacagacagacagacactggtgtgagtgtgggtgtgtgtgtctggctgcgtgcatgcattcctcctgcaggagatcaggagcagtgggcagtatggagtgacaagaagattgggaggtactccttctagccctcccctctgctctgccctccactggagcagaagcaaagcatatggtgaaggggaacaaggagtctccccagcacagtacccgagtgcattagctatttatcactccacagtccccattcacgtgttaattcagcatttattgaatgcttactgtttgcaatgtctatgtcaagctgtcaagtgtagtttttattctacaggccacaggcaccccctaactgtgttaaacaagatggtagtattgagacaggaataataagggtggtcacaggagaatggaagattccaggcagcagtttgactagtaaaaaaggaaactgttgaaatagctgcataatccaggggtcaataagaacctgagaaccagggtgtgagccaaggctggttaaaagcaactggatccaatatggtgctgagtttctcctaggttttgcctggaacctcattatatgctcaataacataccaaatcacacacccaccagggccattccatttcctggaacactcatgtttggtgtaaaaatgggtggcaccacagctctgagaaatctttacctttttcaggaaacttcatgaatattccatcctttggttaaagaaacccataatgtagaagccccaaaccctactgggcgcaactctctctctcttgagtatgcctgcacttccctttattatttatttatttatttattatttatttatttattttttagatggagtctggctctgtcacccaggctggagtgcagtggcgcagtctcagctcactgcaagctctgcctccagggttcaggccattctcctgcctcagcctcctgagcagcagggactacaggcgcccaccacaacgcctagctaattttttgtattttcagtagagatggggtttcaccatattttattttatttttgagacagggtctcactttgttggctcgctgcaacctctgcctcccaggctcaagcaatcctccaacctcagccccccaagtagctgggaggacagacgtgcaccaccacacctggctaatattttgtatttttttttgtagagacagggtcttgccatgttccccaggctggtcttgaactcctggactcaggtgatcagcctgcctccaccttccaaagtgctaggattacaggaatgagccaccccacccgaccacactcccatttcttgagtgtgtgcattttgctctgcaataaatctctctactttcacttttctctgactcgtccttgaattccttcttgtgacagcgtcaacagcctggacaccaggtgcagtcaacgtctcaccagtgtttagggacctcccctaatccactggtatcagcatgatcagacttgctttttcagaaaaagccttctgtccatagaccaaagggaagtgactcagagaaggggcaggaggaatcacaagctccctgcctgaccaggcctggactatggcagagacagtgagatggtgagaaagcaagggtagacagccagccaaatccagaatatagaaagttctacaggaaaaggtggggccaaggtgggacagggggaaaggaattgttgcacattaacagtgcaatgcagagcactggtcttgtttatgtccaggttagaacaaaccaatgagaaagcacatctttgagacaactggagaaatttgaacactgactagatataatattatgttaattatgctttaatttggggtacaataatgcttttgtagctatttctaaagagtccttatctcttaaggatacactctaaaatactagtggattaagttatatgatgtttagactctttttaaaataatccagtggggtgagaggcagagggaagggagaggagcatagaggaaacagtgttggccatatgtttgtaattgttaaaactgagtgatgggaatatggagatttaacatattaatactattttctgcccatgtaatatttgaatattttcataataaaattgagagagagataaagaaagaaaagagaaaagaagagaagagagaagagataagggaagtggaggaaaaagagctttcttcaaggaccattgtggtggacacaaatgaaagatacccccttcctactatgaattctaggtgtgtactacccaagatgagtcaatcggatcctagcttccagaaatcgtgagcatgatgcagccctacagacgcagtgccctggaaaggagacccatgaccatccaaggaagatgtcccatcacagaactgccctgggtcatgtgttttccaagtccacatgtccggtagttccttctttcctatgaccaatgccaccagtcttccagcactgtcctttattgctaggcaaacctgagccatcctcttcttcttgcaacttgtgcctgaagtaacatggacacaaagtccccacttttcccacattctcagaatgaagtagttctccctccacactttaggtgctagaggcaagtggattgcttgagctcaagagttcaagaccagcctgagcaacatggcaaaaccccgtctctacaaaaaatacaaaaattaactgggggtggtggtgtgcacctgcagtcccagctactcaggaggcagagaaggaggatttcttgagccctgaaggtggttgtgttacgtgcattcatgttaagagaccaccaaacaggctttgtgtgagcaattaagctttttaatcatgtgggtgcaggcagactgagtctgaaaaaagagtcagcaaagggagatagggatggggcggttttataggatttgtgtaggtagtggaaaattacagttaaagggggttgtcctcttgcgggtacaggcgggggtcacaaggtgctcagtggggagctcctgagatttattgtccaggagaaggaatgtcacaaggtcaactgatcagttagggtggggcaggaacaaattacaatggtggaatgtcatcagttaaggcaggaactgggtattttcacttctttgtggttcttcagttgcttcaggccatctggatgtataagcgcaggtcacaggggatatgatggcttagctcgggctcagaggcctgacattcctgtcttcttatattaataagaaaaacaaaacaaaatagtgatgaaatgttggggcagcgaaaatttttgggggtggtatggagagataatgggtgatgtttctcagggctgcttcaagcaggattaggggtgacacaggaacctagagagtgagagagattaaactgaagaaagattttgtggtaaggggtgatattgtggggttgttagaaagagcaattctcatatagaatgattggtaatggcctggatgcagttttgtatgaattgagaaactaaacggaagacacaaggtctgaataagagaaggagaaaaacaggcattaaaggactaagaactgggaggacccaggacatccaattagagagtgcccaagggggttcagcataattatttgcttggttggtgagtttttggtctccatccttgagttttttttatgttgtcatatgccaggccagattgatttaggtaaaaacaacactcttcatttaaaaatatacagagttctcctttctcagcagtgagtaagtcaaggcctcagcagttttggaggaaagagaaatgcaaaggaagcaattgtttgttaagaaggattagaaatggctaggagagagtgagtgagattgatagtgtggtggagatagctgaggagaggtagagggtggcataagaatgggaacgagaataagagtgagtataaaagtaaagaatagaacttcatcagggtgaaagtattggagggtgccctgtcagcaaagatcatctgtccactccaagagggagtcaagagtggcggattggggatagtaccaggagatatccactatgatggtttggaggaaaagtgtaaactggcagtgtaaacaggggcagggcatttatgagtcattgagaatggtgaataggagtatgactagacagaagatagtggagatgacaaattttgggggcacagtccaaatagtgggggtgactgcgtagagctctgttgcaaaaagtagggtaaggataaatagacttaatagaatgaagagatgtattaggctcataagggttattattgttcttcagaaatgcgagtgagtttaagggaagtaggggtgagtacttgcgacttccagaaggaagaggagagatcaggctggctgtctgatgggcacagctttattctggaacagtgaatccaatggggagggtcgtgcagacggatggcagttggggtgctataaatgaccaggtagggtccagtccatcaaagctgtagagtgtgaggggtcagacttgacaaggactgattgcccagctaaggtatcttcacatggctgggagtttggaggaggcaagagaagattagcagcctggcgaatttcctgtctagcctgctggaggactggaagataaaggcaacaggtcgtgggcctggatcctgtgtgaggactctagcagcacagccttgtatttcagctgtgtgtaaggaaaaaggatgggacgagtcggggagtgctagtgtgggagctgtctccaggtcctttttgagagagtgaaaggaagaatggggaaaagacttatggtctatgggattagttaaattaccctttgtgagctagtaaagtggtttgattaggatagcaaagcccggtatccaaagttggaaatatccaacaatgcctaagaaggaagggagttgttgtttggtggtgggggttggggtctgggagattaactgaacagagtctgcaggaagggtatgtgtatgttgatggagcattataccaagataggtaatgctaggggaagaaatttgtgcctcagagggcaatactttgtacccctttgagtaaagatgttgaagaagcaggctagtgtcctgctgggaagattggtaagaggggctgcaaagaagaagatcatcaacatattgaataaggtgggaggtagatgggtgaaaagaaagcagatcatgagaaagggcctggccaaagtaatgtgggctgtccctgaagccttggggtagaaaaatccaggtgagttgttgggactggtgggtgtcagagtcagtccaagtaaggcaaaaagaggctgggaggagggatgcaaggggatagtaaagaaggcatctttgaggtcgataacagaatagagttgtggaagggtgtattgaagataggagggtgtacgggtttggcactataggatggatgggaaggacgatttgatcaacaagacgaagatcctgaacaaacctgtaagacttgtccggtttctggacgggtaggataggggagttgtaaggagaatttgtaggctttaagaggccatgttgaaacaggcaggtgataacaggctttaacccttttaaagcctgctgtgggatgggatattggcattgagcggggtaagggtgattacattttaatgggatgataaggggtgcatgatcggttgccaaggtaggagtagaggtttcttatacttgtggattaaggtggggagatacaaggggaggatgtgaaacaggtcttgagttgggtaaaagtgcagcaaagagatgtggctgcagcccaggaatactcagggaagcagataatttggttaaaatgtctcagcctattaaggaagctggacaggtggggataactaaaaaagtgcataaaagaatgttgtccaagttggcaccagagtgggggagttttaagcggtttagaagcctcgccgacaatacccacaacagttatggaggcaagggaaacaggcccttgaaaagaaagtaatgtggagtgggtagcctccgtattgattaagaaggggacagacttaccctccactgtaagagttacccaaagcatctgtgatggtccaggaggcttctgaggtgatcaggcagtgtcagtcttcagctgctaagctgagaagatctgggaaggagtcagtcagagagccttgggccagagttccaggggctctgggagtggttgccaggcaagttgaacagtctgatttccagtggggtctcgcacagatgggacattccttggcccagtggccagatttccggcacttgaaggaagatcctgggggaggaggtcctggagaaatgcctggcccctgcagtttaggtgttttgaagttcttgtgtgctggagatgtggctggggtttctcttacagcggaggcaagtaattgcaactcagaaatatgttgtcacttggctgcctcttttctattattgtacaccttaaggcgagggtaattaaatcctgttgtggggtttgagggctggaatctaatttttggagctttttctaatgtcaggagcagattgggtaataaaatgcatattgagaataagacggccttctggcacctctgggtctagagaggtaaagtgtctaagggttgttgccaaacaggccatggactcagctgggttttcatatttgatgaaaaagagcctaaacgctaactgatttgggagaggtcagctaaagaaaaaggagcattaaccttgactatgcctttagctctagccacctctctaagaggaaattgttgggccggtgggggagggctagttgtggaacgaaactgtaagccagaccaggtgtgaggagagaaggtgaccaaaggtttatagggtaggggagcagaggctggggaagaattgggacctggctaggcctagcgaggaacagcctggggaggaggggagaaatcagatgggtccgtagaaaaggaggattcaaaggactcagagcttggggtggagactgaaggaacagacaggagagaaagaggaaagatttgggatgagtcacattgggagcagagactagagagggactgatgtgtaaagaatgcctggacgtcaggcacctcagaccatttgcccattttacgacaaaaattatctagatcttgtaggatggataaatcgaaagtgtcattctctggccacttggaactattgtcaagtttgtattggggccaagcagtattacagaagaaaataagatgtttaggtttttaaaagagtgcataaaagaatgttgtccaagtccatgcccttcttaatcaatatgggagctacccactccacattaccttcttttcaagggcctgtttcccttgcctccataactgttgtgggtattgatggccaggcttataagccccttaaaattaccccactctggtgccaacttggagaggtcaggtgttagtcaaaggtgttttaagttttaagaacacaggctaagggagaagaagggggaatgaagcgtggaaggttgcccatagtgaaagaggtaagtttaaagagaaaggtagagacatggagaaggggggaggtgagcagccctgggctgtcatgtgggttagcagccaaagctggtgtcccagcaattgacttaccaccaagggaatgtgggtgaatgaccaaggcaggcatccccccggtgatcagacaccaaatggaatgtgggtgaaagatcaaggtaggtgtccccatgatgatcagacaccaaaggaaggctgtcttcccaaatccatgatccatgttggagtttttgagttcatggataaaatgtgtctcctttgtctctactagagaggaaaaagaactggaatttgaaggacagggagattgaagggtagggagagaggctgaagaagagagtgaggagaccgcttacccggtttgaaattggtgagatgttccttgggctggtctgaggacctgaggtcgtaggtggatcttctcatggagtgagggtgaggagaggggaccaatctcccgaaggagtcaccctgtccggggtcttcggcaccaaatgttatgcgcatccatatgaagagaccaccaaacaggctttgtgtgagcaataaagctttttaatcatgtgggtgcaggcagactgagtctgaaaaaggagtcagcaatgggagttagggttggggtggttctataggatttgggtaggtaatggaaaattacagttaaagggggttgtcctcttgcaggcaagggcaggggtcacaaggtgctcggtggggagttcctgagactcactgtccagaaggaatgtcacaaggtcaattgatcagttggggtggggcaggaacaaattacaatggtggaatgtcatcagttaaggcaggagcggcctattttcacttcttttgtggttcttcagttgcttcaggcaatctggatgtatatgtgcaggtcacagaggatatgatggcttagcttggactcagaggcctgacaggttgctgcagtgagccaagatcacactactgcactcctgcctgggcaacagagccacaaaaaaaaaaaaaaagaaaagaaaagaaaaaaaaagaagaagaaaaaaaaattttttttccaccaagaatttagtaaaaaattatagggaaaagtgtcactaattcaagggaattgcactgaaaattattcattcattcaacagatatttattgagaagcaagtatgctggtgctagggttacaacagcgcacaaattcttgtattcaaggaatgaggtaagagtatgcagataggagccagagaggtcaagaggcaattgcaacatagagtgacacgtgctccagaacacataggagggcttccaggccccatgctgggctatcagagctggcttcctgcaggtggtgtggctcagctaaaacctgagaaccaagaatgagccttctgatatctcagggttaaatcggcacaaatgaaaccattttataaccaaacaacattttccctcctgaactgcactttttctagaacccatttaatccttcctaacatgttcaatccagccccgtgatttttcagtcaaatgcaagatgcgtaggattccttttctgttcagtgctccccagccaatctttttcccttctcccaccccacagttactaattccagcgtttcagttctcagcagaggatgacagttccaccaggagacatcagtgttatctggagacattttagttgtcccagctgagggcacagtgctgctggcatctagtgggtgaaggtcaggaatgcacctcaacatcctggaacactcaggacaatccccagcaacaaaaacctacccatccagaacatcaacagggctgtggctgaggagccctgctctagtgcttcctccttactgtatcctcatcaaggagggctctggggcatgtcaggggctgctacaggctcctggcagatttcggcgacttactccagacttgtggaacattcaggattcttagcatggccacaggagagtcaggctgtccacaagcactctctctttcttcacccactcattcctgtcactctaccatttccactgccttcccaaatgcccatcgtgagtcccaccaggggccagaacaccactctctcaagcctccccagtggcgcgtgcacacctggagaacatgtctcacatcccccagccagcgagacgtcctgagattccagcacttctcagtgtctttcccagcttgtttgtatctggaatggggtggggtctctcacacaggagaaattacaaggaaaagtgtacgtgacaggaatggaggaatttctgtggaaacggtgtgtgagaaaatgtaggaagaaagaaacttcaggaaatggtaagtggcatcttgagagcagaaagtgagaagggagcagaaagaaatggggctggaacctgggaaggagaggacaggtggggatggccttgcacaccgtgggcactgaggagtgtgggcccatggcatgggtggagaggagtttcaagatagggagtagattcctattttgaacttcggattgcccctggcgatgtggagactgtattggaagaaggcaagaatggaggagagcccctaggtggaggtttggcaatgctctctccagaatatagcagaggcctcttccaaggtaggaaagccctgactggagagaagttaatggctctgagggctcaagggaggacttggattatcaggacttttagggaggcatatgatcaaggcttgggtcttggcccattgaaatggggagcactggttttaggatgtgggtcaattagtttggttttcaggacaggctgagttggatatcctgggggacctccaggtggcagtgtcaggggaagctggatgtgctgacactgaactcagcagagtgactgagtagagatcgacatctggggtcacaggcagtggatgccgtaggggtggactcaatagctcaagcagaacccggaggaatgcaggcagcaaagggagccctaaagaacagtgaggagatgtgccaagaaagagccaaatccgggggattggctgtgggagagagggctgtgggagtaagaggaagtgtcagcaacgtcaaatgttgcagagacatagagtaaggtaagagtggaaaaaacatccatggaaccctgtgatgcaatcggaatgcagaaagactttgtaactcctgcctggtctcctcctctgcccactcatggcaaaggaatacaaagtaatgttccctccttccgcctagaaaagcacaacttctgcccccaagccctgggctctcctgagaggacaggaccagcctctgaagttgaaggtcctggttctgcccccaagccctgggctctcctgagaggacaggaccagcctctgaagttgaaggtcctggtttaccagatagggaaggggccctttccaagaccctttccagaaggtgtggctgagatgggaaccgtggactctgtgcagatgtaggagctggctccagtcaagtgctaggaggttgtgggtcctgggaaggaagaggctctggagcctctgtggagactctgggactgtccttgggggagacgtgagcaggaagaagcagggccttcacagtccccagcttaggggcctcaccacccagactgaagaccaggaccaaaccctttcctgcacagttacaatgtgtcatttaattttactaaagggaatattttttaaatgaggatgctactttgtgtattaatttttacctctattcataaaagaaacgtttcttatctatttaagatgattcatatcagaccagtgtctgcccaactcgactgaccctgtgaaaactgggcacttcacactccaatgatgatggatgagtccccagcagcatagtttaagggagtgagtgggcagtgtggcctcctgtgcacgtgacttcctccttcagtgtgcccacatgtgggttccacggtcttgtgacattgtggctttagaaatttctgtttccattttctatcattcagagtaaatgaaatttgcaggaaattcagaaccttccacctgtacagtggatactgtgagactctgcccagatgccctcttcaagccaatgcatctctccatgctcccactcccatagatgggaacagaggtgctggaactcagatctactcccctttctgggaactggagctgcctgcccaggcaatgcccccttcccagggatggctgagccaatgactggctaatgttggattgcagaggcctagcgccctcccctcaattcctaattccttgtaggaataactgaggcctcctctgtgaccacgtgggcagcttctccctctgcctggtcctgtcttgttctctcctttccaattgtgtctcctggaagccctccccacaagtctgctgcatacaactctccttctcagagagcctgagccctggattcccaggaatccagcctaaaatagtctggcatttggtttcaattttctctttcactaagactcagtcacaggtgctaataaataataaaatgtcaccaccttgaattctatcactctctcttttcttgccccatctctgacaagtaggtggtccctcaagaacctgaaaagcagacattaggaggaaaggaggagtgggggcaagaggcccacacctcacctggccggctcccatccatgcgcccttgactgaggtaacacctaccctgggaatccttcccctgcctctcgtgagccaggccgggtgctcttgggacagctcccactgctcctgtgtgctcccccagcttggcacatgactccctgaattatagtcagttccgtacctgaatctccctctagaatgccagtgccacgaggacagaggacggttccactttgttcactattttctccccagggtctggcaaagttcctgggacttgggagaggtgtccttcaggagcttggcagaagccaaacggcacacttaagtagggcaactgaggtgagtttaatgaaggattctatacaaaaatttggacaaggtatagggaggccacaatacacagtgcagtgcctggtgccagtgagagcagggcactattcccactgcaaggccagacagggcaaggggagggagctgcctgacaagagctgcccttacgtcaagggacacatcagcccactagaccccatcaggagggagccagggcctgactcccctgaccttgctctccaatcttctgcctaaaattccccatcagccaaacacaactgaaaactgaaagacaggggagcctgctgttaataaggtgagcttcccccagaataaagctgggtagagagtggagaatggatatggaagggcaaaaggaagatttataagacagtgggcactaaatatctatgagatgaataaaggaaccacattttacaacaaacggtcattgaaacgctactcaatggaaagagatcatttcggtcactgtctggtgcagacaaatcaaagcccacatgcatcaaaaaggccatgtccgtgtaactccgacacggggcagacagcaaggctgaagcctatggggtatgtggagccggaactgagagatcctgatgtaaatctagcacttgggaaaagggggactagaagaaattcacccacaggcagaggaaaacacaaacacttatctatttttgcctaggctttaagtggtatgggaaaaatctctgagactacaaatcctgtgcttcatgcacaggtttataataccctcaaaatggaagaccccaaaaccaggcgcggaaaattcatatcaggccattgatgccctcaatgttcccggctgaaacaaactcaaaactcctctggaaaggagtgctcccacttcaagccatgaaaagctactgcagagaaaataatccccagtcaagacacactcacattgaaactgcaaggcacacaaggaaatggatcaccttgagtgatagctggcagagctaataaacctctgtatacctctaagaagctccacgcactagtataacccttaaagatttgatgaaatcattactttattaaaattgtttttataaaaaatcaaaatccaaaaaaagcaacaaattttataccagagccaattcggtatatacaagggtgtcttactcttttggaatttgtcttattgtcctaactcagcacattgtcctggtctatgaaaagtcctagaaacccttctaccctctgtaatgtaggagctttaactcaatagggttttttaaattcttttttcttgtctttttttcttttttaattttttccattttttcaagtcaaactgaagaaatatttttcttttctttctaggaatgcatattcaccccccaaggccacttgtctcctgattggagagtattagacaattctcaggatttctttattttccttctttattccataggattgggaaacccagtaggattgggtttaggcatatctctaaagcaccatgtttcaacgttttgatgtaagattgtgccctatttcttgttcagttgctgccagcagatgttatagttttaaaactagtttttggtcattgagatattagaggagggaagagtctgctatcctgctttactcatcttcatctacactacactgtcatcttcactgcaaagtcctgtattaatgtttttagattctataacattttaacaggtgtcaaaaaatcttaagcaccacttcagcttgggaatctctaaatgtaatggtgtttgtgggctggactgatgtctgcgtcttgttgttgttattgtctgtagtaatggagagccgggagatcctggacacttcctgttcatgggcacttgatgcattagctgccccagcagctgattacatttaaacaaggatgtgtgggtgaacccagggagaccaatctcagtggaatggtgggggcagaagccaggctgcagggtgtagagtagggaatgagcagtgatgaagtagaaacagagtttggacaactagtgaaactgcctggaagagggggagaagagacagtaaatggtctgaccaatgtttgaggtcaaagtgggtttgtaatctttatttaagggacagatctgagcatttaaaaattctgaataatctaatagagaggaaaaagttgggactcaaagaaaatgtgggaaaaaatgatgaaggttaaacggaatgagatccagagtgcagggggagagattagcctttggtgttagaggagcaactctgtccatggagagaggaaaaatgtagacataccacagttgcatttgaagttggggcctgaggagttgaggagttctgagaaaagcagaagatgagatcatttcctgagagtaaatgggagtcattagaacgggggtgaagagactggaagctttaggtagcttgaaatagttgatggaaaaattggataaagtgacaatttgtcacactcagaacagctatcagggaatctagaagaatctctggaagctagttgaagatcttaaattaccaatgtatcttgtccacatagctaagcggttttacttatttttatttttttgaaacagggtctcactctgtcacacaggctggagtgtagtagtagtagcacaatcacagctcaatgcaatctctgcctcccgggctcaagcaatcctcccaccccagcctcccgggcctgggactacagacacacaccaccactcccagctatattttgtacatttgtagagacagggtctcgccatgttgcccaagctggtcttgaactcctgggctcaagtaatctgcccacctcggcctcccaaagtgctgggattacaagcttgagcccggctgctaagtggttttaaacagctgttctcggaaacacacactcaaagaaaaaatgtagaggataatttatctaaggctggggcttcaagagaggtcagggtgttgacaagagaatgactaagtggcagactactggatctcagctagataaagagggatgtgatcgtgggaggggctgatagtcagaggctggaaggcttgatgaacaacacatattacacaaagaataaatggagtgagagaaaccaaaggagtaaaagttgtcatcagaaaagtgagaaattttattgtgagaattcagtggtaaatcaatgttaacaaacctcagctgggcactagtggagtgaaaccgaaggccagggagttgagttaatgagctgagacttgggcaccagatgggggtccacatggacaactaagccaccaggatgatgtgggaaactggggtgaatagaagccccttatccatgtgcacaagtcttgaataaaataggggcaaccaggcagtcagtggatgatagcagtgaggtggagcagagagcaatgtagttggagaagtggagcccacagcagtctcctttatatctagaagggaattaatagccaaaaaatggcaccgaggccaaggatgtcaccttctgactcccaaatctgagacagatgtgagagggaaggagtatcctcaagggacaggagatggtgcgaatgtttttggcataaatcaaagatgtcagggaaattgtcagaattcaggttccagagacacagaggaaaagcgtgggagaaagtggaatattgggaggtgagattagggcagaggaagcacaaatcaaagaacgaggaatagaaaaagtcatatgagctgaggagttggccaaacatgacagaatgggaatatgatggaattaagtggctttatgtgttccaaaaggattggtccacgcaggccacaggaaaatgggaggtaagaagaaagggatcgaaatgctgcaaagtgtattacttcatggtaagcaaaggactcaagactctagaaaatgatgcccttccttccaagactatgttagtccaaatctttcaagatacagaacccaaggtggggtctggcatacaagaagtataatagaggaaatgtctgtgacatttgcaggactgcaaagggagccaggagaagctgggaaagccatgagatcacaagcaggtctgactccaagtgaaggagatggggaatgacgcaaggtttggctgaagcatgtgccaaaggcacccatcagaggagtccctctccaagggatgggcctatcatagtgtccctaatagtgtcatggagtgggagcagcccacggagggcacagccttggcatgaacgcagacatgggtctcagagtgcagcagctgggcccctcagtcaattaggctccctcagagctggggcaggaggtgcactagaccacacagtaatatttatttattattaatttaattaataatattaatttattaatttaattaataatatatttatttatttattattactagaccacacagtagtatttgtatgtctaaggaagcatttctcagaatatactcactgaacttttagcctataagtacctgtatgaaaattttaaaaggggtttcatgatcaaaacattttgggaaacactccataccctttcttcctcatgaaggatcataatgcctattagtatatgaagggctctgagaagtcctgtagtaaagaaacttgctttagttttttagtccagcaatttttcaaacttaaatgagcaatagcctcccatccttttttttacactttttagcatactgcggaataaactcaacatgcattgagaaagactgctttagggaatagtcaacactatttcactcccagtaagtacatataaaatctgtatttccagggtggattatcaacacagctgtattttagaaatattatctgccctcccaggtatcacagctactaattattgggtactgaggtggaattttagggatcagccaattatgggaaagaaaatctgggggcaggataagatggtctccgaagccttaaaattatatgccattatttacctctttgatctactactcaatatcaaacaactaattcagaagaaaattgattgttttctaaaagtagtttttctacatttcccattaagaagcagtggtatttaaaacttataatggctattatgtgagattatcactatcatagtttttctctatacaaattttctgtaacattttatttgctaataaaaattagatagatggattgactaattgataatctaagaaagattatatttgaagaagccatagtaagggacagattaaattatcatcagtctaaacattctaatacctatttctctttttttgaaattttccaaatttgttattatgcatttaaacaataattttttgaacttttattttaggttctggggtacatgtgaaagcttgttacataggtaaccttttgtcatgagggtttgttgtacaaattatttcatcactcagctatcaagcccagtactcaataggtatcttttctgctcctctccctcctcccaccctccagtctcaagtagacctcggtgtctgttgttcccttctttgagttcatgtgttctcatcatttagctcccacttataagtgagaatacaaggtatttggttttctgttcctgtgttagtttgctaagggtaatagcctccagctccattcgtgtttccacaaaaaaacatgatctcgttcttttcatggctgcatagtattccatggtgtatatgtaccacactttctttatctaatctgtcattgatgggcatttaggtttattccatgtctttgctactgtgaatagtgctgcaatgaacattcacatgcgtgtgtcttcatggtagaatgatttatattcctctgggtgtatacccagtaatgggatttctgtttttagctctttgatctaatacctatttctcaagatcaagttagatctctaaaaaaggcatcatcctagcatttccccatcccttccctgaactaaatttaatgttgtgtgtatcaatcagcatacagtcaagacagaaaccacacatgaacattaaatataatgagttattaacttataaaagggtatgaactactaaagggggtaaggagaatgctgaagaatgcaggaatggcagatgtagagagcagccataacctctaagctaaggcacagcagccaaggaaggggcgaactcaaaaaatgccctccctccccagctgatccacccttgttggagggggtgtggctgcaacccaatggatgcccaagaagtttgcagagttgtggcaggttggggctgctgagcaggaaactgcccgaaggggtaccagtgagattcccaagaatgtgggcatgcctctggcgaggaagacgctcttggagtgccagcaaaatttactaggaagctacccagtagggtgccagcaaaagtcagcaggaagccactgtcgtggtgtcggcaaaattcactgaggagtgggcactgcagggtctccacccagcactggcaaatcagccaaaagaacaaaaacaaaataaaaacaaatcccagaaccagaaagaaaaaactctgcctcttactgcgaccctcttatgccttctacagcaactggcaaaggagaaatgtttatggggtccagctctagactcacaaagcagaacacagaagagtgaatgaagagctgaaaggcgataaatcagtaactggagcctcacatcctttgccttttttattgagggtcaatatattaagaagaatatgtctgcgtcttcggtaaaattattgctaaggttatcacccagtgtgtgttttcaacctccctgatataagaacttagtgacaagaaagaatgagacaatgatcatgaactattggacccaaccatttgtggctttagtgcccatcttctcagcaaggctttctctctctctctctctctctctctctctctctcttttttttttttttttttttttttaagatggagtctcactctgtcacccaggccggagtgcagtggcacaatcttggctcacggcaacctccacctcctgggttcgagtgattctcctgcttcagcctcccgagtagctgggattacgggcacccatcgccacccctcctggctaatttttgtatttttagtagagatgaagttttgccatgtcggccaggctgttctcaaactcctgacctcaagtgatccacccacctcagcctcccaaagtgctgggattacaggcatgagccaccacagccagctctcagcaaggctttttctgactacactatttaaaatgtgatccctgagccaccttggcctctcttgctgtccttccctgcttcgccttctccatagcacttctctcctactaatctacaatttacttgagctctgtgaaggtcaggatttttgcctattttgtccattggtgcatccccagcacctggaacagagctaggcacaggctaggcactctagaaatacttgctgaataattgaattaagtaaatgagtgatctacacgtagtggggaatgagagtatacagtgatagttccttcgactaaaactggggtcaaattatagtgataaagaggaactcagaccttcagaggtaagctttgtggaccacttgccaaggctgcagaatgtgatgtcgtttcacaaacaaggaggccctattatggcttcagatatgagaataataaagagaactttcctttcgcctcaactgcagccttctaaactcttccttccttcctatgtagaagtttcaaggacctcatggcctgagtgtggataggcagaatgctgggaatcaggcaaaaataaaataatactgaaagtgaaggtcatgctaatattagtaagccagggtgatcctgaatttacaaaacatttttctttgggaaatttcacacctcacatgattctgtgtttttacttgggaaatttcacatctcacatgactctgtgacatgcggtacatgaggtgcctgactgctgtttttgtcctctactaatgaggaagagtgtgcgtactcccagcgttttgcaagtttcaaagtctgacttgactttccttccttttcctggaactgatccatgagtatcgagagtaaagctgcccgcacctactcattcaagatcctgagtgtcctgcccagctgcaggaggtggagagacccaggaggaggggccactgctgatcccaggctgtagggggtgggaagagtgtcccagggcaccatgacccccactcactcactcacaggagacccacacaagagaggagagggcacttacagcttaggttcccaccagcaccaactcctctgccatcaaacatcattgtgtttctctttctgccttgtctgtcggcacacgtggagttaaatttaatgctcaatcacatatttgtctgggctctttctgtgtttatttttctcttaatagttctctctcctcccttcctctccccgcccctcctcctccttcttcttttttttttccagagacagtgtctcgctctgccacccaggccagagtgcagagtggcatgatcatggctcaccgcagcctccaactcctgggctcacgtgaacatcccaccttggcctctggaatgtctgggattacaggcacttgccactgcatctggctaatttttatattgtttatagatccgggatctcactatgttgcccaggctggcctcaaactcctgggctcaagcgaccctcccacctcatacttctgagtagctggggctgtaggaatgcgcctcagtgccaggctagtttcttaattttctatttctattttgacaggtacaaattttgtattcaatcctacctcagacacatctttggtgggaaaaggatgtcatttaatcaatatataaattctaagcaaataggtctgatccccaaattaggttagtcacagctgctgagtcgttgacccaagagaagctcatctagattttttcattattttcaagttcctcttctcggttcgtccttcttccagaccatgccctccccgtcccactctcttcccacagcctcccctccccacagcctcctcccaccattccaaatctgggctgttctctcaatttccttctctctggactcaaacctaccctagcccccagcctcagtttggggttaaacttgtcctcctcacattctctcccacccaacttgatgtcgcctctgtgtcatcaccacgggattttcctcctctgggttctccttttccgagtggggtcagctcccccatgagtcacagcaccaatcacttctggctgcttgcaaacccctttgctttcctcagtgttgacacccagggcagccctatgctcactgccgctgagaccccacctctgcccctggccttttcccagctgacatcaccctgtggcttccattttcctaaaattctcttttgaggcctcagtcttaaccaaagcacacagtgcccctcaaaaatgacaataaaaacccaaacacaccgtgactgtcatggcaggttcctggtccccgtattgaatcagcgggtgggtttctgcgaacactggtgagaggccgcattagagggtcaggaccctcaggtctggactcgtggtcaccacataccttcctccctgctgacagtagctggtacctgttacctactcagagtgtcacatgccacaagccagagcgtcttggcagttctcagcaccttgacatcacttccttgctaccactcagagcggcagtgacacagttcccttatctcagaaggccagaagacggctgtcaaaggtcacagggaaatcaaaggcggggtacagggccagagggaggaggaaacaacttcccggttgctttcagacgcttcagagatcctctggaggcctgggggagcttttgagtactttatttcagttggtccctgagctcggtgagtggggcgggtagagccaccaggggaatcaacagtggtttctcgtgcccctcagggtcaggagcagtctgatcaaaaggagggcatccactgtccggggccattcccacagctcccggatgctgggtctggaggctgcgcccttcccctgcaggagctcagcccagtggtaagtcatctgtgtgtcatctatgtatttaaccccttatggccatgttgatgctgagcatggtttcacttttgcaaacatttatttatacccttcgagagaaaaacgtctcagctgtcacaggaagctgcttcggggggtgagcaaactttttaaaatgcagaaattatgatctacacccgtttcttaaaagtaagccatcgtacttggttctctttaattatatattttcttacatattgtgttcatgtaggcaagtcctgtttctgctaaaagaaggtaagttctaccaaggcggtgtcatgccagctttatttcccgtggcacctggcacactgctaagcacttacatgcttaacaactagattgggaatggtgctgctctggggaagtgggcacacgttaaagaaatgtttatttcagtcttctgaaatagggaattactctggctaaaatgtagctccagaaagggaaagtggggctgtatgaatccaggtccagtttgttgtttcctccaggataaggcagctgtcggaggggaaaatcatctcccatttctccacagggcagtctgaagatggccaattacacgctggcaccagaggatgaatatgatgtcctcatagaaggtgaactggagagcgatgaggcagagcaatgtgacaagtatgacgcccaggcactctcagcccagctggtgccatcactctgctctgctgtgtttgtgatcggtgtcctggacaatctcctggttgtgcttatcctggtaaaatataaaggactcaaacgcgtggaaaatatctatcttctaaacttggcagtttctaacttgtgtttcttgcttaccctgcccttctgggctcatgctgggggcgatcccatgtgtaaaattctcattggactgtacttcgtgggcctgtacagtgagacatttttcaattgccttctgactgtgcaaaggtacctagtgtttttgcacaagggcaactttttctcagccaggaggagggtgccctgtggcatcattacaagtgtcctggcatgggtaacagccattctggccactttgcctgaatacgtggtttataaacctcagatggaagaccagaaatacaagtgtgcatttagcagaactcccttcctgccagctgatgagacattctggaagcattttctgactttaaaaatgaacatttcggttcttgtcctccccctatttatttttacatttctctatgtgcaaatgagaaaaacactaaggttcagggagcagaggtatagccttttcaagcttgtttttgccataatggtagtcttccttctgatgtgggcgccctacaatattgcatttttcctgtccactttcaaagaacacttctccctgagtgactgcaagagcagctacaatctggacaaaagtgttcacatcactaaactcatcgccaccacccactgctgcatcaaccctctcctgtatgcgtttcttgatgggacatttagcaaatacctctgccgctgtttccatctgcgtagtaacaccccacttcaacccagggggcagtctgcacaaggcacatcgagggaagaacctgaccattccaccgaagtgtaaactagcatccaccaaatgcaagaagaataaacatggattttcatctttctgcattatttcatgtaaattttctacacatttgtatacaaaatcggatacaggaagaaaagggagaggtgagctaacatttgctaagcactgaatttgtctcaggcaccgtgcaaggctctttacaaacgtgagctccttcgcctcctaccacttgtccatagtgtggataggactagtctcatttctctgagaagaaaactaaggcgcggaaatttgtctaagatcacataactaggaagtggcagaactgattctccagccctggtagcatttgctcagagcctacgcttggtccagaacatcaaactccaaaccctggggacaaacgacatgaaataaatgtattttaaaacatctatttaatgtattttaaaataatttgtaagttgattttaaaaccaatttaactacattccaaattatagacagcccatttatatgggagtaacttttcaggctcattgcctcgccggtgatgagaagaactagctagctggaagctgtgggaaaaagaggtaaggtaacttgttctgtcgaagttctctaaattctcttgcttacttgccacacccctaggcccccagcttcccctaacccaaggtttctggtattttctcgtactttatcaagactatggaatcttaggagacttaacaaaagcaaatgagaaattatgtttagaaatgtctaacaaaatgaattctttgtccttttaagtataacacatacctcaggcctcaccagcacataactacaaaaggttgtcccacttcctttctgtggctgagttagtagaacacaggctcccacctgccacatcagcagaaggtcacctcaacatgtgagctacctccccggagaccccccagatccgtaaggatgatgcatccttgatcctaaaaacattttcctgttcctggtgttcagaattggactccacactcactggtctctttataatcttgcttctggccctttgaggcctcaaagctaccagggccttgctgccaggggacaatcaccgctcccggctgagtcctgcagacatagggcctgggctggctgcctcctcctgctggcccagcatcttgcttgcactaaagagagctggaggcttggcactgatgcttgctaaaaacctacccaggccgcccactgctgccgcactgcagggcaccagcccacactcctcccctcctggcatcaggcacacgttcacggcactaaaccttacaggaaagcagtggaaccctgtctttccttcacaggaggcactttccttcctaggcaaaaacgatgatacccatgggcacagcatctcacatagggacacatagagatgtctgactcattaaaacccaagtctctggccaattaaaaggggtccttaatgtcctactcaacagtggtggaaggaaatttgctctatattgatgaaatgaggtggagaaaatctgattttccaaacatgagaattctccatatgccaccccataaccaaagaccccttatttgtgttagatgaaacattcaaagagcctattaggatagcggatgagacccccaagggacatgcttatacaacaataactggctccaaaccacactccatggcagtggctctcaaatgccagctcacatcacaagccctgtgctaaaacacagagttctgggccccatcccggagtttgtggttcaggaggtctggagtgtgacctcagaatatgcatttctaacaaattccccaggggatgcagatactgctgacccaaggccctccttctgagaaccactgttccagggagaagaaactcagctaagtaagggtttggctttgtgctgaagacaatgtggaatttagagttggggtgaattattcaggaaagtagagaggtttggagatgtgagggtgggaagcgcagtggagggaggcagagaggaaatatgaagcagcgtcagttggagagaaattaggaagaggaataaaatgatatatgccagggatttcagttttgctgagcccatgatgacagactcttctctggcaccttatgccactcattgagggcttgtagctggctctgctctttcagagtcataatagggctatgggtctgacctcaaggtgagctggaatgggcacaagtaatagataaaactgcaagaagtcactcaagggtccttcctagaacaaaggatccctacattccaaaggcgaatgccggtcactatcataaaagaaaagaaagaaagaaactgatggtgacattttaaatggcaatttttctagcttctaaaaggttgtggagcaactggaactttcataccctgctggtgggaatgtaaaatggtataatcactttggaaaaattggcagtgtcaccaaaagcaaagcctatacctactatccatttcactcctcagtatttacccaagagaaatgagcatgtatgtccatacaaagatttggacccaaatgttcatgacagccttatttatatagcctcaaactagaaaaagtctgtctatcaacaggtgaatggataaacaaatactggcctgtgtatctaatggaatactgctcatccacaaaaagaaacgagctattgatacacacaggagcatgcacgaaatctcaaaatgctgaatgaaggaggccagattttaattttatttttaattatttatttatttatttatttttgagacagagtctcgctctgtcacccagcctggaatgcaatggtgtgatcttggctgactgcaacctctgcctcctgagttcaagcaattctcatgcctcagcctcccaagtagctgtgactacagtcatgcacaagagcaactgactaatttttgtaattttagtagagacggggttttgccatgttggccagctgctctcacactcctgacctcaggtgatccacctgcctcggcctcctaaagtgctgggattacaggcatgagtcaccgtgcccagccggaagccagatattttttaaaagtacttattttgtgattctatttatataaaattctagaaaatgcaaacaaatccatagcgacagcaaatcagtggttgctggagatgttggaggggagaggagaggaatagattgcaaaggggaacaaggaaattcggggggacagtggatatgtctgctattttgactgtggtgatggtttcattggtatatacatatgtcaaaaacgtaacaagttgtatacgtgatttattatgtgttgactatacctcaaaaaggctattttttaaaatccccctcaggctccaggcactccattacgttggtgtgacttgtcttggaaatatactttgagcatttgccggaggagatccagtgcctgggcctctgtttcttctcccaagtagaattggcagctaaaacgggatgcccatgggcacaacttgtcacccccatcaccgaacagggagcagaaggaggctgctgggggtgcccccacagggagcacagtctcatcgggaatgacctgccatggcaaataaaatcaccagggcaagtcaagggagagaccagggaagagagtgatccagtctatattaaaaaaggatgagaaaggttgaagaaaaagagaagaagggacagaaattctcttcacacatttgcagaagtaggtccggactctccatccacttctcctcctccgataggtaggacaggaatctcagaggaaatggcatcatcttcccatgtttacagacacagcaatgaactcaaagaacaatcttatcaggattttccaaatgaaaacatggagcatatagagaataaagatccataaactcgtatggtggctgagactgaaatggttaatgaaaagcaaaagtgtgtgctgaatgacaccagccacaatggcctgaacacttaagtagtgtaatatacttggaacattgacagctaacaaggtcttcctcccatgtcagaccaagaacacagtttcctaaagataaaaatagcacatgcttttccacttttccataagtgactgcattagaaaactaacaaaccatgaaaagcaaaatatggctagtctcttcaagaaaaactggtgtttctattttgtctgtaaattactttctaatacaaaaaacaattcctgttacattgaggtaattctaactagggacatatgagagagagattgaaatctcatgagctgtctccttttcatctcaattctgtgtactcgtgggtacaaatggaactagtttttgtttgtttgtttgttttttgagatggagtcttgcgctgttgcccaggctggagtgcaaaggtgtgatctcggctcactgcaacctctgcctcctgggttcaagcaattctcctgcctcagcctcctgaatagctgagattacaggcgcctgccaccatgcctgactaattttttttttgtttgtattttttagtagagacagggtttcaccatgttggtcaggctggtctcaaactcctgacctcaggtgatccacccacctcggcctcccaaagtgctgggattacaggcgtgagccactgcacctggcccggaactagttttaaaacaggaaacagttgatatactgaatggaaaaacaatacaatttgaagttgaaaaaacaaaataagatgcccagttaaatttaaatttcagttaagcagctaatagttatttagtataagtacaacccatatacgacaattgcagtatttgttatttatctgaaattcagacttacctgggcatcctagtatcctgttttttgttttgttttgtttttccctttgttttcttttttttccccgaaatctgaccaccttaactttaaggtatttattcatttttaaaaactaaatatttttcggcagtcagaactagagcaaagataaatgatcccaggactctgtttagcaggcagtcaggaagtgtgacagtgtggtgggtggcagccccggccaggcctttcctcttccctaaactgccacagcaggactgccacacttgggaatcccagtttccatctgagcagcccctccagagtttggaaggagtcagtgctttagcctgaggagccgtggatggctctaacactttgcttgtcggttgaataaaaatcaacccaaaggtggcctacactcattgaagtaggaatgccagaacttcagtggtgtcacatagaagaaaatatctaagtgcttagggagatggcagtgctagtggatctactggatcattaagactcactcacccacccagcgcaggtctagaggacacacccttgccacactgggaagtgtaaatgagctccagcatctttatttttttttattttttatttgttttattatactttaagttttagggtacacgtgcacaaagtgcaggtttgttacatatgtatacatgtgccatgttggtgtgctgcacccattaactcgtcatttaacattaggtatatctcctaatgctatccctccccccgcccccggtgtgtgatgtcccccttcctgtgtccatgtgttcttattgttcaattcccacctatgagtgagaacatggggtgtttggttttttgtccttgtgatagtttgctgagaatgatggtttccagcttcatccatgtcccgcatctttaaaaaaaaaaaaaaatctctaagtggtggctcttctctgtagatcaggagctgtagtgagcaatgctacaaaactggagtttctaaatacaggggggatggtgggattctgaggaaggacaggccacgtggtaacacttacaaaagaccaagtgggtgtggttgccactgtggacggtggagccaaagcagtcctcagaatagtctgacccccagaggtctttggcattggctggttgatcatggtgtccctggaattgaaatagaaggacggtctactaaatttttacctgatctgtataagcagaagagttctatctctagtgaacagaagtctaactttagtcaccagaactgagagtcaattcaatcaattcccagatttgacatagtttatagacctagaaccccttgaatgaaaggtaagctggctccccttgaggaaggaccctgttacatttccggcattttattctgataatcttttttcccagccttccccaaagcaacttagggccatttaccagggaaagccatggaggaaaaggaaataattaggctatttggagattccaggacactggctctacgctgacaccagttctaagagacccaaaatatctttgtggtctaccagccaaagtagggcttcatagaggtcaggggtcactagagtttgagctcaggtctgtttcactgtgagtctagagggtccctgaacttatcctatagttattcccccagttccagaatgcagaattgagctgagagcagtggctcatgcttgtagtcccaacactctgggaggcgaaggtgagaggatcacttgagccaagcggtttgagaccagcctgggaaatatagtgagaccccatcttttaaaaagacaaagaaaaataaagaaaattgacatggaaaaataatataaaatgtgaataatctcacatctactaaagaaattcaatctgtaattagaactcctcccacagagaactataagcccagtgcccccatcaactggagaaacagaaagaaacaatcttcttaacagaaagcataattggaatagagatactctgcatcggggaagaatccccatattgattctctgatccatagagtgaaggccaagtggaagcctttggaactccctctacctgccaagatactaaacaaaacaacactgcacgtctggaggaattgtagcaagaacttgaaagatgaaggatgatgatgtccacctctctccattcagctcacctatctggtttgtgcagaagacaaataggtgttggaaaatgacagtggaccagtgtaaacttaatcaggcgggggctccagctgcagctgcaggatcaggtgttgtttcatttctgcagctaatcaacccttctcctggcacctggtgtgcagatggcaatttttcttttctattatctgttagtaaagactatcagaagctgtttattttcagttggcaaggtcagcaatacactccaagggaagagcagtctgtctcagatcttaccgatgcctggggatagggagggagtggccccctcaccgtctccaaggcctagtcctctgctcctgctactggcagcaaatccacgcaggtctgcaacaacctcaattcctgcctcctcagaagaaagaattcaattgagggacgtaagacagaaggagagactgaggcaagttttagcacaggagtaaaagtttatttaaaagctttagaataggaacaaaaggaaggaaagtacacttggaagagggccaagtggacgacttaaaaagcaagtgcgtggtttgaccttttgacttggggttttatacgtcagcatgctttcggggtcttgcgttatttctcccctggttcttcccttggggtgggctgtcccatgtgcctgcctgagcccactggctcaactcctgagatcttatagggaaactactgctcaccagtttcgagtgttttctatctattaggagccggcttttccctgttgccgggtgtgaccaattattactttagaaagacagtcaacaaccgccagaccatcacctgatggtcacctgacactcctggtgtgtggggtatggggagccctctcctgccctgctctttctgactagctacccactataacactcccagagggacctgcacattttgtgctctttgcaagacagtgcctgcccagcacctgtaggcctgctcaccccttcagggtcatgatttttgctttttaccgcaggtacccataagcaaaacatggcattgttcaccatgcttttacattattcacataattttaagttatttacacaacaatgtaaaaccatggtgaaccatgccacatgttgcttatgggtacctgtggtaaaaatcctgctactagctcattttgcagtgtctataatgacaggtaatgctccattcactcctttatgacacttgcaaaaactgagaacataacgcctcccagttaagcaggcatctgggcaatgtgaggagaacagaaatagaccacgctgcatttatctctcttgatgacaggcattgagatttccactttttctggtttcttattatgtctctactgggcattcttacatacatcttgcacgccatggaaagtttctctagggcagtggttcacaaactttttggatacagaatacttttatgtgcttgaaaactgaggaccccatacagctttagtttatgtgggtgtaaggttctagcccaaactgaagtccgaagggagttggtgggtgggtgaggggtagctgaaaaaacacccgaggaatcataggcagtttgaacatggccttatcctctctctgggcacgagccatatgtccagtgtcagcagggtaattataccttttacagacaatagaggctctgaagcaatcacgagctcacgtgagtggtcacctaatgcacctcaagtggcatggttcataatgtgcggagtcgtgtgcctacgctccaaacccactgagtcatggtgcaccaaaaagtggcctcagcctgctcctgactaaagcgcagccatcttccttacactccacccctaggccaggggcatcctccaggtagggacatgtgcccgtagggtggagccctgaatccataatccacagcaacaatacggagagcaacagctcatgactaggattccagctatgctacttatgactatcagggcccagcgtaggccagagcccagggatgtctaccatctctgcagggggtcatcagtaaggctcttgactaccttaatctcctgtgagaccccttgcagggctgctgttatgttctgccaattgtcagggataaaggtacaacattgtgttcctaaaagggcacaggtgcctccttaggcagcagttactatgtctaagaccattcggtttcgcaacaccacctttctgatctgatcaacctcatccattaatgggaagagggccactcaggtgtaattcagagcctgagcagcatgctctgcaagagcagtaacttggcttctacagttgtgacacacactccagggctagtgcctgtcaaggggtaaaaccaccagggtgctcattacacttgcaaaaaccgagagtgtagcacctcccagttatgcaggcatctgggcaatgtgagaacagtggcaggtacatgaggccaccctcaggtataatgtccagtccagtttgcttataggtaaggccaccctgtgtccccacagacccataaactcccagggggcacacagtccatcgaggccccttggtggggccgcgtcttccaccatacctttggtgtggtgacatgtattatgcttacacacactgtgacgggtacccatcccacagtgctattaccccagtgttgctatatgcaccacagtgcctgggccaggggtactgcacgttacctcactagccagccccacccatcataaatgctatgggccagccagggaatggctgtgctgtgggtcttgtggcatcctttgtccaaaacttgccacgttgcgttccaggcatcagccatgggaccccaagtctccagccatgtctggttctctgcagatgctgaatgtatgtgctaaggcaagccatctgcagctgctagaagggcggtgcagatccaacagttggaaacattggtcacttcagtgtaggtgtgggcccagtccacaatgcagttggagcatgttaacctacagttggaatgacagagtaggcataggtactaacagaggaaaatcacatccctcaggtaaaatacaggctaacctttcatccctggataacaatgcagcccccaaggggttctgccctgggcaatagtaccacaccttttcagctccccatggttcctttgggtcctgtattcatgcgaaagtcacaggggagcttgtagtaggccacacagacagtacatttgaaccctggaggaaagtttcttccctggccgttttcctacaaacagttaacttcggggaccattcattgaacacccaaagagtgacatacaagtcatactgtaggccctccccacagggagctacgatggacaaccaccagcagccgggggcttggaggggctatggccacagccaggttttctgttcccctgccttcagggacgttggggcaggcaacaacaggttactgttcatccccatacctggtcagaggcggttacccttggtgtgtatctgcaactgaataggggtggtggcccatgtaacaaagcctccacctgggctgggctgcttttccatggccattcattcaaggtttggagcatcaggtccagcctggaacttcagccctgcaaagacaggagtgtgacatgcaagtaaaacccattcttcaagagctcgctatatcactcaatcatacccacagcttgcaagttgtgcggtacatggaatccctactttatgtccattgttgtgcctgttgtccagtaaaatgtgtcccccatcactctcaatgaccaaagggcaaccatatagagcacataagtgttgcagggtctggatggtgtgctgttggttggccaccctgcaaggataggcaaacaacaggcctgtggctgtgtccacagctgttagcgcatgagtatacccttgtgacttcggcagcagcccaatgtagtctacttgccacctggtcaagggcacttgccctgttgtcacttgtgtagcactggacagctgcctccatttagggtatgcctgagcacatgccgggcatttctgacaagcctcccaaatgtcttgcatgggcagagacagaccccaacatttattgacttgttgcatcagtttaccccctgcatgtcccagtttccggtgtagctacaaggccacatctcatgtagatgccaactctaaccatcggaccttggccaaggcttctgcctcgtcattgctgggggtggccagaggcatatggcctgacaaatgataaatagttacatctttgcaatgacccatttcccagaggtcttgctacatgggttggtggccccaaatgggttggtggccaactagccaattctgtattttccaagtagttaaacacaaagttaggcctccatagactgcccagctatcggtacggattaccataggtgtctccgccttgttgatcaccatccatactgctttaaattcagcccattgactactttgtccacatctggtttcaaaccatatggttttggtactaagttggactgcaacactggtccaagcaggagtagcacctcgactagacccatctgtgtgccatgccccatcaggaatagagggatgcccttccttaaatggcagtggctcagggtcaaggggtgcctcaggccccatggccttctcttgcattaggactgcaggtcccaagacctcttgcaactctgctgctaatgggcttgtgctcagcgtactctgttgctccaagtaagtgcctcactttgccaaagtggatgtctgcaccatcccagtctggggggtcattacacatgaatgcacccatcccgctgtcaggtaagtcatccacactgtgactgtagcccatcctatcacttctcacaagcctgaagggcagcatatacagctgctagctatttctctatcaaggaataccagagctcagctcctttccatagttgggaccaaaagcctcctggcattctcaggcactctgtgtgctgccacaggcccaaactaaaaccatctgtggtcacatgcatatccagttcaaatgggcaccccttgtcaaatacccacagggctcgtgcctgctgaatagcccacttggctgccaggaagccagtctcagccacatcagcccaatcccagattgctcccttctttgttaactgatacaatggttttatcatttgagctaaatgaggcaggaatgtccaccaatatcccaggaggctcacaaaagtttgcagctgcctcaccgtggtgggccagggatatgcctaaattttgtcaatgatagcctcttgtatggccttcatcttacccgaccagataactcccaagaatttagcaggtaatccaggccctcggaccttggatttgttgatggcccaactgcatgctgccaaatgttgccacaagaggggtgccactgcttctaaatctgcaagagaatcagaggttaacataatatcatcaacgtaatggaacaagtggactccctttggacattttcaggctgttaaatccatggcaacaagaccatgacatatggtggagctatgcacatagccctgcagcaacactgtgaaagtccattgtcatcaaggcaaactgttcctggctctctagagcaaggtcaactgagaagaatgcattggccaagtccaccacatagtggtactgtcctaattccattgtcgagtggttcatcaaatccatgatagatggcacagcttccaagccatgtaaaatatccacctccagaatgtattcaggtatgggagagacatacacagtgtataagcaaggagccaagtggccaatgccaaggtacagagatacaggtttcactttcactgactggcctccgtaacctttaatatatgcagatttgcccaaaaacttaactgggttcccataaacaaggctacaatctatgccagtatctaccagcaccagcacccactgtacattggtgggggaccagtggattgccaattccacatgtggcctctggtcatctggtgtccccccaagccagacacctttggccagttccctagttgaacagaaaaggctctacatttccacctggctgcagcaagtagtctctgagctgggtaggaccaggtcacacagcaatgcctttctcccctttgggcattttccggaattgctgccctgcatacaactgtctccgcaaagttaggagtatttcattgggctgcttatcaattttctctcagtcaaccccagccaaaatcaaatctatccacatctgtgagcgtgtcactcgttggggccccctttttttatgggggagccccctgtgggtggggtaacttccccttctttatggtgtggaccctccaatccccctgaaggccttctgcttccctgagagccgccatggcagtggttacttcatgtatgcggtgccctacgtatggggtgaggacagcagctagggagccaaaggggctcaggagcatcaaacccaacatgagatccctcatgtgggaggtgaaacatttatcatctggccctcaggtattcaggacaaacatagcctgccgcatacccatctcccgaatgacttacaccaaattggcatatgactgccatttactcacagttttgggcatttcaccagcattattccacacagttcatatggctgcctgtagccactcagtcagggtgtggtctccttgcgctgccactaaccacctgctcacttgcagccgctgacagagagaggggtgagtcatggtggaggccagcttgtccatctcagaggtggaatgggagataccatctgctcccttgttccacagacgaagcatccaggcaggcaggggttcccctggacactggcaacactgcttgcctaattcctgcaactcagttggggtacaggcaatatacgaaatgtgttgcattatggtggggagtccctgagtccacccttggagccccagtggctgttcatgatctaccttctgtcagaccaccgggtgagcccgcaacaggggttcttcctccttggtatgaaactgagtggggatctccagacaagatgatggacccaggcctgcattcatggtagcctctaattccttttccaagctctgaagccacacctccaggcatcctgcctgcacctggaggtccccattcatggcagcctctaattattttccagatcggtgtagccagacctccagtctgcatccctcagggactgggtgtgtacttttcttagcacagttaaaaatgcccatccaactctgccagcaaaggctctctccttcttggtgctctgcacttccagctgcttcagcgccttctccatgctcatgggggacccatctactgccacccaggtttccactcaagcccaccctcacagcacggctaccaccgggtaccacaacccatgttgtggtcacatggccaacctggaatcagcagggaccgaaggctcacttaccttaggatcctgttcgtgatgccaattgtcaggttctagcccaaactaaagtccaaggggagttggtgggtgggtggcaggtaactggaaaaacactcgagtaggcggtttcgacatggctttattctctctctgggtgcaagccatatgtagtgtcagcagggtaattttaccttttacagacaatagtggctttgagccaagcacgtgctcatatgagtggtcacctaatgcacctcacatggcatggttacataatgtgtggagttgtgtgcctgcctccaaacccactgagtcatgctgcaccagaaggctgcctcggcctactcctgactaaagcacaaccatctcccttagagtgggctaaatctactgctatttatactattagaaattttaacacagaagttttaaatatttacattgttaattgattttgaaataataagcccattacaggttaacataattaacatacttttattaaaaatatctgtattttttaaaagaaaaaaaattagcaacaacagtgatccttggaatcgtcccacctcagcctcccaagtagctgagaccacaggcgcacatcaccatgcgagctaatttctatattttttggtagagatgggatcttgccatgctggccagggtggtctcgagctcctaagctcaagtgatcctcctgcctcggtctcccaaagtgctgagattacaggtgtgagccaccacttctggccagaagctggattctctgtcttgttctccatccaatctgttagactgtcaaatgccaaataacctttggaaaattctactcgtaaaataaggagagagataaataacttctgagtatcatcattaaaatagtttgacctcatggacccactgggtcccatgtggagaatagctctaagctaaagagtagaatggctgggaggggacataaacattcagcccatagctgctgaccacaataacacattttaagtctcttcctctcctgctccttgtgattgcagacagactcaatctgtaggagagctgtagagagaacaagctcaagcccctgattttgcctacaaagaaagctgagcccagcaaagttaagggacttacccaaggtcacacagccacacagcagagctggggctgagctccaggtgtcctgctacagaggccacttctttctcccactagggactggcctgtgattacttcagaaaacaatggtcagctaactgattctgaacgccctttgctggtaaaagctaatctcctgaggaaaaatgtatgcattggctgggcgcagtggctcaagcctataattccagcattttgggaggtggagacaggtggatcacttgaggtcaggagtttaagaccagcctggcagtcatggtgaaaccccgtctctactaaaactacaaatattaagctcggcatggtggcaggcacctgtaatcccagctactggagagactgaggcaggagaatcgcttgaacccaggaggcggaggttgcagtgagccgaggtcgcaccactgcattccatcctgggcaacagagtgagattctgtctcaaaaaataataatagtaaaataaaaataaataaacaaataagtatgcatcacctcaggtggtcagtcagctttcccaagaccccaaagcacacaatgttctttctggtatgagtgacatggggttcacagcaccacaaagtccatgacttttccctcagaagtgaatgcatggctaattattttgtattttttgtagacatggagttttgccatgttgcccacgctgctctcaaattcctggactcaagtaatccacccacctcagcttcccaaggtgctgggattacaggcatgagacaccgcatggcctgcacctatagtcccagctatcaggaggctgaggtgggaggatcacctgaaccggggaagttgaacctgcagtgaactgtgatcgctccggtgcactccatcctgggcaacagagtgagatcctgcctcaaaaaaaaaaaaaaagtgaacacacatgctggggaagaggcctgcaggcacccctgccagttctgcaccagagcacactgtagcagccctgctgtgatgcaggaagcagctccaggtcctgcagtctgaagcatggagcctgaagcctggagccccccatccaatgctgcgccatgctcaccagtatcccccagcatcagcaccgaggcaccagctgcagataaatttctcacctaaaatgttgagagatgttgctaaactgtccttctaagggtatgtataataatacggtcctgccgatactgaataagactatctgtttcattacatcctcacaatactgaatatcattagcaacttgaattttaaattgtgctaatcaatgaaaatgattgcctaattactagtgagttgaggttatttaacattaatactccttctgatgaaatattttgcatttatcacattttacataaattctctctatataattagcactagaatgtccgacttggttttcattgttcctcacctgtttggaaacacattaagaatgagggagagaatggatggggactcacctagggatgcatggagctggtcggcagccactctgaggccctcttaacacttccccaccacacacttaatttcccctggtttgtccatagatacatccaacaatttttatgtaaataagaaagactcagctttcaatggaaaatggtaggttggattttatgactgaagtggcaaaaagaaataagggattttattatgggggaggtccaaaccctggtgaaaaacgaaattcattgaaattgtttgaaaattcaaggattaaatcagattattttggattcagtaggaattagattactttaaagccccaggatactttattctgtagaatgcatggaaagtatagaaaagagaaacaaagagggaaagtcatggctaataacctggaaggggtaaatagggagccaaaggcctgtgggacgtaaccaactcagcattccactggaggctttatgatcaaatagcaagctatttatcatgaatgcaggatgtgggcaaactcacgactgctcccactgccagaaggtttgctgagggcaatcacttcctggcaccgagctccttgaggttatctactgggacatctggagaatgcagtcttgcaagcctactctggacccagcagctgaccccttcttccatgcccctcttcctgctatctcttttgcctaataaatatggagggctgtgtaaagctcagggcccttgtccactagaggcaaactgcccgctgaccccttcttccaaatatgctcttttgtctcatgtcttttattcccgctttcaccccactttgttcagtccccctagggccgtgtgggttacatagtggcgccctgaacagcgacagaatcaggtgctctacaagtggcgtccgaacacagggactatgaggatgtgaatgaagaagatctgctggagcagaggaattgaaattgacaaggtgaatggggatcccgggacaagtctgccggcagcagatataaggtcagtgccctaaagaggtactgggagcagtgccttaaagtagtactgggaatgggaagttttctgaatcagggtaacatggggcagaattggtctgttgaagaaaaacattatgtgcagttgcttaaagttttgttgaaacaaactggtgctcaggttagttctcacattaactacgatgctacaggaagtcattatgcataacccatggtttccacaggcagggactcttgatgtagaaaattgggatagagcagaaggattaaaacaggctcatcaaaaaggttttcaagttgattcttcagttttctccacttggagtttagttcgtactgtacttctgccattatctccttgttattctgcgggacagcaggctgaatgtaaaaatctgaaagaatctgttgtcccacccacagctccagttgaaaataagtaataggagagggaggataaaaattggcctataccgccccctccagttgcagaaacatctgtaccgcctccttcggtggcagaaacagagaccccaatacaaagaattttacgctctgccgccacggctggagagcccttaggaccttgcacttttcctatttccgtaagtcctgatccaaataatccacagcagcttaatcatgaacacattccactagagtttaagttgttaaaggaattaaaagtgagtgtggtaaataatggcatacagagcccattcactttaggattgctagaatctatgtttggtgctatgtgtcttttaccctttgatgtgaaacacttggcatgaacttgcttgtctgctagcgcatatctgacatggaatttaaactggcaagaacagggtgcagaccaggctagacagaaccatgctgctggaaatggagacattacagaggataggctattgggtaatggcccttattctgacctggtacatcaactagcactcacaaatgctgcttatcagcagtgcacacaggctgctaaatgtgcctgggccataattcctgaagagggagtcccagtactatcatttttacatatcatgcaagggtcacaggaaccctacgcacaatttcttgcaagattacaagaggcagtgaggcatcagattcctcataccttggctgcagaaatgctaacctttactctagcttttgagaatgcaaatgcagattgtaaatgtgcactggcaccggttaggtgtacaaaaacttgggaaattttctcagagcttgttaagatgtagcaactgagctttatcgatctgcaatgttagctgaagcaatggctaatttagctgttgacaaatctaaaaagagccaagggtcaaaccctaaaatgggaaaatgttataattgtggaaaaactggacattttaaaaaggaacgccaccagatctcaggacagaaaggatcttacaatgcttttccccccggcccccagcggaaagaacacctggactttgtcctcgctatgacaaaggaaataactcggctaatcagtgctgctcaaaatttcatcagaatggcacccccctgttgggaaatgagatgggggcctgtacccgggcctcacaaacaatgagggcattcccaattcagacctcaaccctgtttcaggcatgggttcccagaggcatattgagtccctcacccgaggaactccaggaagtgcaggattagatctcccagccagagaaagggttacataaggtggggaagacaaacccaccaagattctcactggcatttggggacctttaccagcaggatatatgggactaattttaggcaaaagccaccttaacttgcaaaggcattactgtagtcccagaagttgttgactctgattatgaaggagaaattcaagtagttttattgtcacgagatcttcgggtttttgaaccgagagaatacataatgcaattattacttattccctgcaaattacacccttctccatgaaaggagaaacaaggaaataaagggtttgggagcacagctacacgggaaatctatctatcccgacccatagcctctaatagacccacctgtgtagtacaaattaaaggaaagaaattttatgggtttatggataccggagctgatgtgtcagtgttaccagcaggtctttgttcttagagctcccaagatggcggcaagccttttgttctctgacctggagttcttggcctcacagattccaaggaatggatccttgggccatgcagtgagtgtcatagctctattagaagctcttccaaaagtcgtgctgctatctatggactaaaacatactcaaacaataatgacctctggcgtttaggctcaatgctcagagctaattgcagtcattcaggttttacagctcacagcttcagatcctgtcaacattgtctgtgttcagtttatgtcgtaaatgtagccggtcacatagaaactgctacaattaaaagtacgctaaacccagaactgctaatttatttttaagacttcaacaagttatttgttctagtgcagctccttttcatatttctcatattccttctcacacacaacttcctgggccgctatctctaagtaatgagaaaacagacaaactgattgcctctgtgtttcagcaagctcaaccatctcatgtgcttctgcaccaaaatacttccgcccttactcacatgttcctacaggtttgtattatattatgcagtatatccctcgagccacacctatagaaggatgtaatccacgaggtttggctccaaatgaaatctggcaaatggatgttacacacacagcaacctttgataagctgagctatgttcatgtgactatagacacttattctcatatgctgcctgctacatgccaaacaggtgagacagctggtcatgtacagcgacactgtctgtcatcatttgctcatatggggatatctaaacaattaaaaactgacaatggacccgcttatactagtcatgcttttaaaaatttcttgcagctttgggctataacccataaaacaggaattccttataatcctagaggacaaggcattatagagcaggcacatcaaacattacaatgcatgttgaaaagacaaaaagcgggtataggaggccaactaccacctcaataaaaactacatttagccttatttactttaaattttttgactcctggtatggatggtaagactccagcagaaagacattggcaagtgttagaagaaaagaggaaaatttatccaaaagtgttatggaaatccctggaagaaggaaaatggaaaggtctggtggatttactgacgtggggaagagagtatgcttgtgtttttacaggagatggacaagccgtgtgggtgccctcaaggtgtgtgcaaccatggaacgggagactagaggaacccagggtggccaaccatggacagggtccccccggtacgagccatgagccagctgagcctgagtgcaaagacggagagaaggccaactggagtcacaacacagttctaatgttatatttgtaaagaatatcactactcaacttacagtttgtgtttatagatatagatatagatatagatatagatatggatatagatatagatatagttatagatatagatagatatacactttaagttctagggtacatgtgcacaacttgcaggtttgttacataggtatacatgtgccatgttggtttgctgcacccatcaactcatcatttacattaggtatttctcctaatgctctccctcccccagcaccgcctcccaacaggccctggtatgtgatgttccctgccctgtgtccaagtgttctcattgttcaatttccacctatgaatgagaacatgcagtgttttattttctgttcctgtattagtttgctgagaatgatggtttccagcttcatccatgtccctgcaaaggacatgaactcatccttttttatggctgcatagtattccatggtgtatccttatgtctttttgacagctaagaaggaccagctccaggtaaacaatacccaattgacctgtaaatcttaccaattatatcactgcattaatcatagcacattgcaaacacataatatctctactttgatgattttaggccacatccctgggctatgtattcctgttaatctgtccgaggcttgggctgccacacctgctttgcattttgtgaaacttcttctaactgagcttactcatcatgtctgtagagccttagacataataattttagctattgtttccttggtcgcactaataacttctgttgtgatgtcctctgtagctttgcataattctattcaaacagctcagtacatggagaactggacacacacagccgaccaagcatggctacttcagaataaaattaacactgagttacaaactgaagtggtgttatgggaagtcagggaccccaaagagagggaccagctggagccacagcagaggaacgtaaattgtgaagatttcatcttaatacggatatttatcagttctcaaataatacttttacaatttcttatgcctgtctttaatctcttaatcctgttaccttcgtaagctgaggatgtgcatcacctcaggaccactgttataattgtgttaactgtacaaattgattgtaaaacgtgtgtttgaacaatatgaaatcagtgcaccttgaaaaagaacagaataacggtgatttttatggaacaagggaagacaaccataaggtctgactgcctgcagggtcgggcaaaaagagccatatttttctttttgcagagagcctataaatgaatgtgcaagtaggaaacatatcgctaaattcttttcctagcaaggaatattaatattaataccctcggaaaagaatgcattcctgaggggaggtctataaatggccgctctgggaatgtctgtcttgtgcagttgagataaggactgagatacgccctggtctcctgcagaaccctcaggcttactagagtggggaaaaactctgctgtagtaaatttttggtcagaccagttttctgctctcaaaccctgttttctgttaagatgtttatcaagacaatacgtgcaccactgaacatagacccttatcaggagtttatgatttttctcctgtcctgtttcctcaggagcatgtgatctttgttctcctttttgccctttgaagcatgtgatctttgtgacctactccctgttcttacaccccctccccttttgaaatccttaataaaaacctgctggttttgcggctcaggtgggcatcacggtcctaccaatatgtgatgtcacccctggaggcccagctgtaaaattcttctctttgtactctttctctttatttctcagccagccgacacttatggaaaatagaacgaacctacgtgaaatattgggggtgggttcccccgatatgtgatgtcacccctggtggcccagctgtaaaattcctctctttgtactgtctctctttatttctcagctggccaacacttatggaaaatagaaggaacctatgttgaaatactgagggtgggttctcccaataaagtggtaatgttgaaatccacagttctatggttaggggaaaagcacaaagcttgcaattgcagcagcaattgcattgtcattttaatcacactcatatttgtgtaaccaacttagaatataaccaaagtgagtatctgtgggacgttgtgaaagcccatttgcagggagctttcacatctaacatcacctttgatattggtgaattacaaaacaaaattcttgatttacataggcaaattcaagagtttctgccttctttagaagactggaccaaattccagcaaggcctggagagcctcaatccttggacttatctaaggcactacattaacatcttacatgtagttcttggaataatattgttttgtctctgtcttctgttcatagcctgtaaaattggatggaccaccaatcggaaaatgagagctgcccaccctggccttacattctttcaattaattcataaacagaaagggggatatttagggagcctaaggctcgtgggactgaccaactcatcattccactggaggctatatgataaaacagcaaactgtttatcatgaatgcaggatgtgggcaaactcacgactgctcccactgccagaaggtttgctgagggcaatcacttcctggcaccaggctccttgaggttatctactgggacatctggagaatgcagtcttgcaagcctactgtggactgagcagctgatcccttcttccacgccccccttctcactatctcttttgtctaatcactacggagggttgtgtaaagctcagggcccttgtccactagaggcaaagtgccccctgaccgcttcttccaaatatactcttttgtctcttgtcttttattcccacgtttgccccctttgttcagtttccctaggtccatgtgggttacatagtggcaacctgaacaatgacagaatcaggtgctctacagaaataactttttaaggaaagatttgggacttagagaccccaggagacatacacaaaaatgataagaggatgtgcccaaaccagtcttaaagttgtggcacagggtgaggaagatgaagctgttactgaacctcagagagtgactggtgttacagcaaaagttagcaatggcctgaagggagggtttctgaaatcaaatatgaatgattccccctcagggaacccaaccttgggaactactgcatggttctctgtatgggaaaatatcattaatgcaggataaattgtgaaatatcacaggaagcatcctgcatctagtcaatcttctgtttctggggtggcctgtgcagctgtgcaggcagaggcccaaccatcctggtgagtggcacacagggactgagatccagccacacctaccaggccatgctctgggaagggggtgggacctgggcaaaggacacctctctaggactgcacagaagcctttgtgggtgggtgggacattcctgtgatggccttctggctgggcactatgaaatgctctgaagatttttccttgcactgttgcactaaccccagtcctctatcactgccccttcctcctgggcgacttcactgatgttgtggccatgtgaattctctggccaatgaaatgataaagatgatatggcctctgccaagcagacactgtaagtattattgtatgatgcttttgtctctttttttaaagttaaagcagtttattaagaaaataaaggaataaaagaatagcactccataggcagagcagctgcctctgtctcttatattttcccctctgcctcaagcccaacatgcccaaaattggggctgctggttcagcctgggtctcagaataaagacatgagccacagatccattgctgacccatgatggagatggacacaagagagaaacacatttttgtcatgttagccactaagattttgatttggaggccatttgctacagcaatataacctagcgtgaacagagagacacagcgatgttccatttcttttcaacctggaacaggagaatttcataggtgggcctcaatttcactttagtatcttatttagacaagaaagttcatactgttcaaatgtcatgtttaagagtgctggcattatcactgctgtggctaccccatcagatgttgctcactgactaatcttctcatgttagtgaggatggacaacatatcaggccataattcaaagtagcaaataggaaaagagcttcatcctagcattatgggaccttaattaatgtcctttcctgacaggtttcagaggcttttgcaggcagcagcagagctattcatctcactgacagtggggaacatggccaaatggttgcccccacaatggaggcagagtttcaggacacttgtctgatctctgcccttgaaggaacagtctcaccctgattgacacttttgcctgttatgtccaaagaaccaatggaaaagcaggaaaattattccttcttcatttctctcttcattatttaaaattattctgtcttcacttctctctccttttctctgcttcctacttagctctttagaaatgcaattataatcttttatctccccttcaccagacactcccaacagggcaagttcatctaactatgtgctcttagttagacgctacagagcagaactctctcccaccaagagactaccttgagacataacagtcaattcacaagccaaaatatgcccgctatgaaactctcccatctggaaattttttggctgcttttacaacctagttttgcccacaaaggcaccagcagtaaccaactcaactgcctggtagacaaggcaccaaagccagtacccagaccctctacctgctcacttcctgccttgcatgccacgccccccatttaaaagcctctgctttctgctccaaaggtgaagcagttacccttaaggaaagaagcctgtacttcttcccctaaggtagctttggaataaaagtcactttataccaaacctagctcttgttaattagactctgcaagtgatgagcaactgaacctacatttcagttataattcctatgcttgttcttcctgccctgccttggggacacgcacacactcccaggcacatacatgcacgtgcactgagacagctatgtgaataaccaacaagatccccttaggaaaaccggtgcttggcctggccttaaattccagacccttgggcatcatacccaagactgcaagaaagaggaggggctggacctgaaaaacttggaagggaaggtccaactgtacaggtattttgtcaggcatgtgatttcagtataaaattctagaaaagatgagtgacactttataaggagagaatatcaacaaaatttctcattttacttcttgctaagacgacagcagggaattgtaagcagatggatgggcaatccccaccttcagcaggggaggccaaggccccaacacacctggggagaagagctgggggcagtgaatggctgaggctttcttggggagctgggccatcttcttcggttttacttcctgaggaattcacaggcttccaggagggctgtgggacacaacagagcaagagattcagaaactgatttcttccattaaaccagttatttaatccaataaatcaaagagaatactaagagttttctctgcccttctcccatcactgagtcagtgcttgccacactcatattcccactcccctactcctagcgactacggtgttcaagggagccagagtctagccctcaccagccagggtgtttccctgctctggcctgagagacacaaccaccctgcacttgtctctgattgaatcgactgtcacattctcaagttcacaagacattggtggtcctctagcttctcccggaatgtgaacctgtttgcaatcatgttcacctgcagattcactcattcattcacagatccttactgagcacctgctttgtgtgagttgctgtgctaagtgctggggacacagcatggatagactggcctgccctcaagaagcatgtggtctatgcagtcctgagctggctgctcacaagaagagccctgtagccatatttctcagagggtggtcctgacctgcatcacagtgacctgagttgtttgtcaatacagaaaagggtttctcaaccttggcactattgacatttggggcctgataataaccctttattgcagggggctggctgtgctttgtttagtagcatccctggcctctacctatttgttaccagcagcaccctctatgttgtaagaatcaaaaaaatgcttctcacattgtcaaatatcccctcaggggaaaaattgtctctcattgaaaactaccgataaagacatttctggccctgcccccatccttggaccaacagcatccctaatgcccccaactctgggtgagggaccaggaataggaatctgaatgattgcagtgcacagggagctgtgcacactgaaatcccacagttatcaccgggagccttacaatactctgtgatgtcttctaaatatttttaagggattaaattaatatcaacatatttccctggttaagatgtgttttcctacacttgaatttttttgagattttgttttctctatagttggcatctatggtaactgtctagaatcagatttttttttttttttttttgaggaagggtctttcggtgtcacctaggctgtagtgcagtggtacaatcatagctcactgcagcttcaaccttctgggatcaagcaatcctcctatttcagcctctcaagtagctgggactagaggtgcttgacaccacaccaggctaatttttaaaattatttttgtagaacaaggtctctctgtgttggccacattggtctcaaactcccgggctcaagccatcctcccacctctgcttcccaaggtggtgggatgacaggtgtgagccatcacacctggctggttttgtcatttctcaatgcatatgtatatatgcacctttcattttactgaataaaatggattatcagtttccaaagatttcatgacagtgccgtcactatccgtactataaaatttataaaaatttattacatactgctctattttattctctaattattttatcaatgagattataatttcctgaactgtaaagagatattatctttccttaacatttttacacctgtgttcgttcctagaatgctgtttggccctcaaaccttgaccttcacccatggtggtttctcggggatgctagctagggtctacttacgggaggttgagcactttttcagattagtaatgcctgcgacatactgtggtcccaaatatttttcatatgttgttttgccatggagtctggccagacactcagtgttgtcattgaacagaaggtttttggtttcagactggaataagcaaaacttgtccgggcagtcagatccatttctcccaaatttagcctgcgacaaaagggcagacagtgagtagctaaggaaaagaggaatttgtgggttaaaggaggcaaaggggtatttcttccacccaagaacagccctgagaaaaccatggggcagaaggagctgagttctggagtcattccacctccttagtggagtcccccaccccacactcctggtggcaggcccgccttgggcagcatccaggcctcacaccacttctggtcctacctcctaccatctgccatctttccttccttcttaacctgtgaccttttcccatacaacttcttatgggtgacaaggcaacaatggaggggttttgagatctgccctcacaagtcaattgctcaggacattctaatatgcagctcttctagagaggcaggctgctaggaaaacccaggctcagccactaaccagctcagtgtgcaggtcggtcaccctgcctccctcacacagttcctgctctgtcccaggctcccatgtggggagactgagacccaaacccctcagtcacggcagctctctcaccagcaccactgtgtgtgcacattaagagctccataaaggccagttatggtggccagtcttgttattcctgagttgttttcttcaaaagcacacagagacatgatgttatatgataaaaatagaagttctaataaaatcccagattttaagaaaattttgggatttcgttcaaatcacatttagagagccctaaatctatagggcaccttctgagtttgctgttttagaggcctggtctagagcactgttcactcggcccaggttcaggaaatgtcacctgagtaaaaagcactatactaatgcatgtgggaggaaggctcagtggcttcctcatttgccagaagaacagcaggagggaaaaagacagcctctgagccaggcagtgatggcaacaaggccagggcacagagtctcagcagaaatggagtgagtcccagaaagcccagagtcaaaagcctctgttgttcttgttgacactctgggcaacgccacagcatgaagccaatactctcaccatgagcttcaagtagaggactagagaggatcgagtgggctggtgcacctagctctgtgatctcctcacctaacatgagcccacacagctaagaaagcactagaagccctgtggtccatacctgttggtggagcaacacctgtttcaggcgttccaccttatccatccgagacaccacggcatgattcggggccatggcaagatggcagcttctagcctcagtcacaggcttccgtttgccatcgaggcacagcagcgcaaagtctgccagcttcaaatccttagcccatgcgtcattgttatttcctggggagaaaaagaaggtggcatcatccacgcctcccctgcttagccaagaagtctcttctgggtgggtgtggccattccactgacctcccaaatgcacacactggggttgtggtgatgtgaggaacagagaaggagcttcatcctacacaagctgtacaaacttcaaatataccaaatattagtgctgtgtccatgcaatggaatgttattcagcaataaaagggagtgaagttctggtacatcctgcaatatgcatgaacctcgaaaacgatgctaagtgaaagaagccagtcacaaaagaccacacaataggctgggcacggtggctcatgcctgtaatcccagccctttggaggccaaggtgggagaatcacttgaagctaggagttcatgaccagcttgggcaacatagcaagacctcatctcaaaaaaaaaaacccaccacatattatatgactccatttatatgaaatgtccagaataggccagcctatggagacagaaagtggattgatggttgccaatgctgaagaaggatagggcaatgactgataataggtgcaagggtttctttatgggaggatacaagcgttctagagttggattgtgttgatggctgcacaactctgtgaatgtgctggagatcactgaattgtacactttgcatgggtggattttttagtatatgaattctacctcaataaagctgtttagagttcttatttttttaaagaagaaaaccctccacctatgccatatttttcagtgagttccagaaaaagaatagatggtttacattcaaggagaaattggtttctcctccctttcatattcaaatgctattagtgtaaccagagaaaggaaaggaacttttataggtttatcaaatatatacagccaattctaacaaaatacagttgtaaagtaccggagaaagttaaaattaaatttgacatcaatctgatccctggagattacttcagttaatggcttgtaaattctaaatgtaattgtatgcatgtctatgtttgtgcagatgccggctcattgttccggctcccgtttgtctctctgctctctccctttaagaaagcactttattcattctcttggattcctctatttgatattgaaataatttcaaatttacatgtcttgttttaatctctgtcccaagagacactagaaggagcagaagcagaagggagaagtggctgagactgcagtgattactgaaggagggaggccgaaagtggagacagttctttctcaggaaacagaatagcaagtcacctgctgagacttgggggttggaatgctgaagtggggctaaggagacagatgcagattggaaggtagcaaatggctgaggaccaggagagagagtgattgttcaaacattggctggaagattatcttccatcatctgcaaccacctgtaattttgttcccactaactcccaaggagtctccagaccaaggctcacatggggatgaatgaaggcctctacttcctttttcataaagggaggcttcatttgcatatgttcacccagtttgtagcatcatccacagtttccaataggcatgcatgatctcatgtgggcagacagtgtgtttctgtggttgactagaggaagccagggagacatttgctactgagcatggctagtatctgtgtgtgtgagagtgagtgtgtgtgtgtgtgtgtgagagaaagagagagagtgtgtgtgtatgaatttcgtttcaaaatccatatgacacctacagatgttatcatgttgtctattgagataaagaattttggagttcttttaatcacaaatatggaaaatgttataaaaccttcccaaaggcaaatctgaacactaagatgtgttgtgatgccaaagactctgctttgaaggagaaaaggaaacaccttcacctaccatcagtgttctgcaagacagtgacatctttcacaaatgcaacgtctccagcattctcagccaggcacctaaaatgttccagaaaatatacacataattacagaagagaaactagtggggctttcataaatatttgtaatatgcattccaaaaactgaaatatggaagtaaacatctaaaagacaactatttctaggaatttactgtttacagcggcagattgaacacaggtgtacctgccctccttttaaaaccctatataaaagacattacaaaaccaagaaatctaaagatatgcgacccaggaaacaggcaatctaacatgaagtaagacaaaggaaagcaccaaaataatggtcaacaggacccccaggaccacagatgtgcaggcggcctacacagcaaccagtccaaactgcagcaggaagatggatgccttctggagcagcacttccaagtaaatgatgaaactgtgatagcacccagagagagagagagagagagagagagagagagtgtgtgtgtgtgtgtgtgtgtgtgtgtgtgtgtgtgtgtgtgtgtgtgtatgcatgttgttaggagatttacattactggcagacagtttggggatgagatagtgatgtgtttttttaagtgcagaaaattaagcaaataagaaaagacatttatgaactccagagtaaacaaaaagtttgtacaataagggaaatataatatgagaataacgcttacacagtcataagtactgaatatgacattagcgtgttgggtgctgaagagagttgaagtctgtggttgtgtggtggaaaaggtgctgggggcagtgtgagaggctagatcttcttctatactacagagtcagcagaaagttaaaaattaagaaccagcattataaggatgatagaaataaaggggtatgacactggtttcagcttttaatgattttgctataaatttccccaatctagattctagatataatttaaacaaaagacaagggattttcttccagtataattaggaatattaaaatgtgggtgtttccagtgaactaataccttgctgcaggtctgaaaaaaaaaaaaagaggagcacatgcttctttcgggctcttatgagacatgtgttcagcatttctgagtagaatcacatttccatttgcaaatccttagtcccttaaagatatttttatacattcacaaaacatttttttttgttttgggtctttttttatgagccacttatatagcaaaagctacttttctgtcattccattactggaacaaggctgttgaatttatattaaaaagttcagacaccctcagacacatgacgccatctggtcgtgaaatgtactcttggcaaatggaggaaaaggaacaggggaagatcctctctgcacccttcacactggtaaatagtgcccctgagaagcaacacccggatgaatggtgctgtaaaacgtggggtgtggttacaagtcactaagtggttataacttatgaattctgaaaacttgttttttggcttatttttcacttcgttactggagaataacactgcaattctgccatctctttgccatttctaaggccaaagtcagagaaaaagggaaacctaagccatagtcatgacctaggtgagaagaaaaggggcggcgatgggaaagagaattcttccccataaatggaattgtaggaagcacttaggataccacactctacccatttgattttcaggacgaggctattgaggcctactgctgttgatcttggctcaaagccacagggagaagcactgcggagctgaggtcagacagccctggtgccagcctccactctctggggcggtgggtgtggtggggacagccctcactggggccacccatgagctgacccacaggatgacccccactctgctgtgacaggtcacatctggctccttagaactgcaatgctgacatgctgagggatgaggtaagtccccatcctgatggagctcagtcacagactcaccggaaagccccagtgtagccgtagtatctctcgttgctgttgggcacgcacttattctcaccctgctcgtcgccaatacacagagcacagagattagatctcgggtcagacccaggggcacagctttgactgaaatattcatctggagagaaggaacacggggagtcagctcttcaaacctgagtccacacaagcaacctttacctaacagccgatgcagggtggtttcagttcattagacttcccaggacagcaatctagatagaacacactcaccatcacaaagcaacatgttgtcaccaacataggacccaccagaaaagcttcattcagactgtaggcacagatggacacccaactaaggctggggatgagagctgtggctgcctggagggtcccgtcatcacagccttgagctggggactcagctcatgaccgtgatggctgtgtgcagcagagcctgtgagttgcctagtccaggatctgattttgtttttatcagtaatggaaaccctgctttgtatctgggtgcttggccctttggtataaagactagacttatcagactccctggggctcatatggccatatgggtagctataggccagtgaaatatcagcaggagtgttgggcgccagcttctcagaaacatccttgaaagacaattggtacatgccttttgccctttcttctccttctctttcttcatcctgcacatagaatgcagaagcagggactggacttagagatgcaatgtgggccatgaggtgaccttgagcatgaaagccacacaaatggcagagtagccaaatgattaaagcccaggttccagaccccatattgtcttcataccagccctaggcaaaccacctctggactacatgacacagaaattaacttctgtcttgtttaagcctctactatttcaggagttttctgttccttgcagctgaacctgatctgaattcgttcattgtgtgatttaacccaagaaagaataaacaaaggtgacaagaaagctctgccccactgagcaaacgtcacccattatcagactcccactgctgctggaagagccacactatgtgtcaacctcaggaaaagctgggagttcccattccatcctggcagtttccctacagctcagaggctgccatggagctggtgaggagcagagccacgtgaaagctgcctgccccggccaggatcaaaaacccatgcagtggagcccctgccctaggagacgcccatacaagaagggagtcacattgaggatgtgctacacaccatgccacggggcccacagcaggcagggtgtggctgatgctgactaggatgagtgtggggtgtggtggggagagaaaactgcagaagcaggtggagccaggctcttgaggtcttattcaggctccgttgcagtgtagagtaagcgtcagttttgcttagtaacaggagtcacctttcatgaggcaggcagacatctttccccaagctgggaagccagagtttaagaggaatttaggtctggagctccaagaggtaaaaagcatttgcacatcttggaacttgcatttattcttagggtgcagcgaaataggcagatattccaatctttaatcttggggtggggtgaatggggcatgggaagtgctgtgcagggaaacccccagtgcacccacgcctccagggggcagccacagggagaatttccttatgctggaagaggcctgcaggccactatcagcctgcaaatcccctcccctcccttccctaaggttccacagcacaatatgcctaccctccagggtggcccacccaccgcacctttggaactccttaccaaatttgcaggagcccgtctggttgaagagcaggcccatggggatattccagcctgcagtcctgtccacggcggtgtggcaggacttcttgcctttcacagagttccaggtaaggctagtgtctgatctcctaaccaccgccacagcaagatatcctggcataacagatgacagaaaaacaagtcttaacctccaggaggcctggcacatggattccagtggagctgtctacagcccaggccaaaacaggccaagaagcaacaccaggcaatgattccctcaaagaactggcctttttaggtagaccgagaaagcataagctgctgccttatgttaaggtgagattgatgaaataaaacagtaagaaaagctgattattttagtgattacaggggactgtcttcaaccagccacacaatgtccctgagttacaaaccagcaatgcatctctcagtgtaagcttctacagcaacaaacactataaacaacaagagagaccccaacagtgcataaatcaccaaccacagtgtgcatcaggcaagagcaccaacatccagccagctaacggctgtgtgggtacaggggcacatgtccccagggactgccctgagctgagtctgaacccaccctgcactggttgaactcaacatggttgccgttgtcctcctgagagaatgcatctgacagacacccaccaagggcaagtcttttctgaaactgagcaagcaccagctctggtgggcaggaggagtggtgcacagagcactgggacacgagtcccaggtcacgaggacccggggtcaagaccaggatctaccacagtattacctatggctgtgagtgagatcctgggcacttggggactctcggtgccactgtttcctcatccccatgaggtggggaagtagcaccccccattccatgaccatgacaaaatgagggactatatggatgttctttgccaagtgtgaaggtcaatataaacattaattagaactattcctctgtgaattatttgcacccttaaaattattgctcctagaagccctatagcttctagggctgcaattctttctgttttttttacagttcctgccacttcctcttccagcaacaagaacttatccttgaccctgaaagtggctaatgccaactcaccttccacaggtctatccacacagttaggatcagggtcactgctttgttgggattctgaaagaataaagacaagccagacatcattatccattcagatgtagtgagaagccacaaactcttaaatctcaatgatgcagaatcaaatccaaagagaccgtcccagcagttccatgcaggagaaatgcgtctatatgttcaacaaaagacatggcacagagattcacagctgcattattcaccacagccaccaactggaaactactcaaatgcccatccacactcaaatgatgaataatcacagtagactcacacagcgacgagactgaacagtctacaactacacacttaggtggatgaaaagcataacgatgagcaagagaaaccagacataaaaaaacacatgctgtgtaattcctttaacatgaagtttaaaacataggcaaacttagatctgcgaccttagaagccaggagagaggcttcccttgcaggagtaagggggcgggggacaggaggacataaggggcttctgaaacttgcagtgtttgttctgggcccgagagcatggactgtacagtgtgtgaagtgccatgagttgtacatttatgtgcacttttctgtttgtatgttataattcactgagatcttctggaaaattaagaagataaaaccaacctgtcccttgttaattctcaacacaataggctttgtgggtaacacggcccctttcatttcttctttccctgattctcccttttgaatgtatctgttcatcataatgtttcacctgcattcaccgaatgggattactcatagccccactcccatgacccagagggaatataccagaggatgctaactccacttactgtagttctctgccaggacaggcaccaaaccacatttgcctgcagtgtacacatatcctccatccaaactcatggcatcagcttctcctttctgcaaagacagagcagatctccagcaccacagtgaggctgcatcccgtcctgcctgtctatatagctctctgagagaatggttttctgtcaggtgaccagtgaaacagcagaaagagatggactattcaaactgagcagccagaggaaacaccgtgtgcaccactaattctctcccagccctgcctactttctgggctgtcaattcaactggaaagaccaggcacaggttgcactaatcctctgtcctctgagcaaaaccttttctgtgtccctggcactttggggacaccttcctggagcagtctcactgactgaggacacagatgggaacagctggcctcatctaatctgaactcattagcactccactccaagcgctacacagaagttgtccaacacataagctgaagtcgtcatattggcccaccaccagaatgaacaagtccaggctacaacacaggatcatggactcatcagtagtatgaaacttcctctttgacccagtaatatttttacaactatattaaaaatagagaagtggacaaagatttctactcaagaatgctcaccacagggttattgataatagcaaagtaagggacaaagaggaatgggggcatgactaaactgagccatattcacataaaagatatcctggaagcatgtttaaaaaatgttttcgtccgagtgctgtggctcacacccgtaatcccagcactttgggaggccgaagcaggaagattgcttgagcccaggagttcgagacgagcctgggcaacaaagcgagaccctgtcgctacaataataataataataattatgcaggtgtggtggcgtatgcctgtagccccagctacttgggaagctgagatgggaggatcacttgagcccaagagttccaggctgcagtgagatgtggtcgcaccactgcactccagcctgggtgacagatcaagaatctgtctcttaaaaaaaaaaaaattaatgctttccaagagtaaatattcatgtggaagaatgcccattatacgctgtttagtgaaaagggcttaaaaacgacatactgcaacacttcattattgttgcatgcatatctgcagatgtgcagagaaatactggaatggagaattagccagactttaaccatgtctgtccctctgtgtgagatcacaggtggtttggggggtttgttgttgttttgttttaacataatacctttccatattttccaaattccttataataatcctgagttgttcttataaccagaggagtgggaaacccacagtaaactgctttttgaaactaaaatgctttctggccctgagcacacctctccaggcatccctgcctcacccaggcccccgtggcctctttgactgttgacttcactttaagcagatgcccaggccctaggtcttccaccgggcccaccgcccgcccctgtgatggagctccctaccagcaccagggcgatgcagtcctctgtggtggaggccgaggagcaggtcacgctgccttcgctcaagccactccactggttacacttgcgcagctcctgctcgcccaccgcacaccacacgacccgcgcacgccgggcagccacttcctcctcacctgccagagggaagaccgcaggtggctgggcaacctgagctttgccaggttgtccaacctccccagagccagggtcctgcccagactctccctggaacaggagctacagtacatgtgtggacatgtggacccataccctctcctcctccacttctcagctccaagccccttcttcaggtccacagagctccctgtgtttcccacttctgttcctttggagaagttccctggcttctaatctatccattaatctttagagtcaggaggcgcctattgtctctgtctctgaggataaacgctccatgacccagagaccagtgacagtcccaagagatggcctaggggaccttgagcccaaccctgacttcccctaacgcctgcaatcaccaccaataactacggtgcagcctctgggttcccccagactcccacccccagccccccagtagagaaggagccatagctgagttcccccaccatggtgtccccaactaagttcaaggtctgggcctgggaagtgtgggtaaatccaggcccccggattcatccaggaggggtcctggctatctttgttcatgttcatgtttctcacttaataggaggcaaactgatttttctgccaggcctggggagcctgacgtgcactgatcaggtggccagactattcttttagagacacctgacctaatccacagaagacactcacacctgcatcaaacctccacgatgaccccacagtgtctgggaaaaggagtgaccgccacaaagtagggccacctgctgggaagtagaagaccacaccaggcggacctcaggaccctcctgggctcactcacttttcctcaagttctggatggcagtgaagtagccggagccaaggtacagcccagaatctatcctcgggggcaccctcgaaaacccaatggcagagtccttgaacagcagatctttctgcccactaggggagccaaagagctggaatttcggtgacttgtcctttccaaacttttcctaattaagaaaaaatagaattatggtgtcaatggtaaatagggaggaaacaaaaaaatgatgttaaaaaagagtatctggagctttgggatcattctaactgagagcaggagcctcggttgagaccctcctgcagagggacttgtgccatctcggagacccaagctcagctatggctcattctttgaagagttgctgaggtccaagcaccttagggccctgagaagattgcatcgaccaccccctgcttctgctcccatcataagacgctgtcagcccgtgtgacagaagagtttcattgcttctgctgtccacagtacagcctgggcaagcagcccaatgcattagtgtgctatcctgcagcaaagctacaggacttctggagtggcagaagtcagggaagtaagaaaccttgctccctgccccccatatccaagcaagtggggaggaccgtgggtgaagatacctgtgcctggcggagaagattccagatggcatcctccttgccattcacacttcgtgccacaacggcatgagaagggacccgggccagatggcagtctttgaacttgtccactggcttccgagtgttgtctgggcagagtaactcatactcgtccctttcagcctcgtctgacaggtcctctgcagggaaggtgaggtgggagggagtctagataagccgactccagcagtaacctcgagctatagttccccttctccctatagaattttgagcttggggagatagctgacaaaactgagggtcagaaaggcaggggtttgctccagaacactcagaaaggtaaaggtagtgccccaaaagcctcagggggcagccgaggtgtgatcctcatcctaaatcacttaggccaccctggggttcccgtgcagctgctgcctggcaggccagagaggccaaaccagacccgtctgtttctgcggcatctctgcctggaaaagtcactttgcagagacaagctcagggggccaccaagggttgctcccttactcacatctctgggaagaataaaaatgacaaaaatgttaacaaggcagggaataaggcaggaaggtgagacactttccaacactgagtatatcaaaagaaggggaagaatggttttatgaatgagttcaggcaaatgtggaatatcatatataagttgcttcagaatgtgtaaagtgaaaaaaatcttgcccgagtcattttatgagattagtacaaccttgatgtcaaaatcagaaaaagtataggagggaagaattaaaagtttattttacttacgaacataaatgcaaaatttgtaaataacgtactaactaactcaatctcacagagtatttaaaaagctaatagattggaatgaaggtttaccagtgtattccattaacaaaagaatggctgaacatcaaaaaaactaaagtaatctgcatttaatggcagaaaaccatgagatcgtcttcatcttaatagatgcagaacgattgtttatgtgttcaacatctatttgtgtgtggtttttttttcagcctcagaaaaatagtaatagatagaatcggtaaagtttttttgtttgttttgagacggagtctcactctgttgcccagcctggaatgcagtggtgcgatctcagctcactgcatcctccatctcctggagtcaagagattctcttgcctcagcctcccaagtagctgggaccacaagcgcacgccaccaggcccagctaatttttgtatttttaatagagatggggtttcaccatgttggccaggctggtctcgaactcctgacctcatgtgatccacccgcctcagtctcccaaagtgctgggattacaggggtgagacaccacgcctggccataagttattggcttgataaatgccattaatctacagcaaaaaccttactaaaagaagaaaatgtagacattcaccgcaaaatcaggaacaaggcaaggatgcccactgttacaatgccagcacaattctagatatccagatcacacaatttacaaaagaaatgtgagatataaacactggaaggaaaaagacacactcttatttaaaaagatgatatcgtcatctacaaaaaaccaatgaaaccaacagaaactaataaaactactcagaggagtaacaagttataagagcaacctacaaaaatcagatgttatcctcattaacaataaccaaatagaaaccaatatggactataagatgttacaatagcaactaaaaccattaagtagctaataattagcctcccacaaagacacatcagacccacaaaggaaaaattttagttctatcaaagaaactaaaaagaggtgtgatcaaatgggggagatttagcatcaccatggactggacaacttaatgttataaatatgctgatttttcatggaacaatttaaattcagtacaattcgaatcaaaattaaagtatgattttttccagaaattcaacaaaataattctgaagttttagctgagtatatttgaaaaggaataataaagtgagaggggagagggagctctctctcattctctctctcttcctctcactggctctctctctttctctccaccagatagtaagacccattggtaagccacagtaacaaaagcagaaaaaatgcaaatacaccaatgaaataaaatagctcagaaactggtccacttggatatatacaaacttggtgtagaattggcttcacatatggcagaaaaaatatactttttttattgtaaggtaaattgcctcactgtaaaggggataaaatgctaaagccaaatctatatctgactttctaggtagagcacatataaatagatgaggaaggggatcttcaaatcttattttaggaaataattatgatttgggtgtgaagaagggcatctttgaaatatctcaaaactacaaaccaacaaggtgaggcttgtggatttgaccttatcaatatcaaggatttttgatcaacagagactaccgttgtcagatttttgactgagaagaggttttactaaagtttaaaatcagcaatagtttgatacctagatagaaggaacttctgtccttgaatcaaaatcatgcagaaacaaggtgtgaaactcaatttaaaaagtagtcaaatgtcacaaaataagaaagggaagcccaaacggctagcaaatatgttgaaatgatcaaactcaccagctgtcagagaaatgaaaattaaaaataaaacgaactatctattgcattacaaccatcattcggacaaaaagtatgaaagtcaaaaatacttctaactgaagttgtggggaaattagaacacttgcagagtgtcattccagacagcagcttggtgatcctgggtgcatgtggggtctgtctctggtggccctgggtgcatgtggaggtctgtttctggtggcctctgatgaatgcggggtctgtctctgatggtcctaggtgaatgtgggtgttgtctctttctctggtggtcctgggtggatgtggggtgtgtctctgatggtcctgagtgaatgtgggtgtctgtcactttctctagtggccctgggtggaatatagtagccctgtctctattggtcttgcatgaaatgtagtgagcttatgtccactagtcctgggtgcagtgtgtttagcctctacatactcatcaactgctttattataagtccaggagggacgctgtccagcaggtaagtaaggaacacaggtgaaggtatcagtcgtgtggctgcatgtggtagaggaaaagagagcacaacctctgtccatcactatggtgacagagaagtaaaaggtggatgtattccacggaacactcctcaactgttaggacccctgagctagacatgtatacaacaataccgataaacctctaaaacaaaatgctgagcagaaaacccaagtagcaggatttctaatgctcactaaaacctctatgaacccagaaaccggaaacacaaaccagcacaatctgttctgcatgagcacatgtgtcttggaggactggaggacgcattgccaagcacctaggcatgggtgtctatgaggggaagagaaaggcagtaggcacaggaggtttgaagaaaactgatcatttaaaatatgaaagatcataaaatcagagctgtgccctgtaggaatcttgaaaatggtctgccatgaacttaggaatctaattagctcaaaggtcagagtcatgatcaagtaagataaaaggggtcagtacccacggctcattaccctgctcttaccaaacactgtgctctctctgataaaagccacgtctccagccccgtctctcagacacctgtgaaaagagaaaccatcaggggtaagcacaggcagccctccccagcccctccctgtggaacagtagccctggcactcagcatctatgggtttctactccctgcagggcagggctctgaagcttaatgagttcaggcaaatgtggaatatcatatataagttgcttcagaatgtgtaaagtgaaaaaaatcttgcccgagtcattttatgagattagtacaaccttgatgtcaaaatcagaaaaagtataggagggaagaattaaaagtttattttacttacgaacataaatgcaaaatttgtaaataacgtactaactaactcaatctcacagagtatttaaaaagctaatagattggaatgaaggtttaccagtgtattccattaacaaaagaatggctgaacatcaaaaaaactaaagtaatctgcatttaatggcagaaaaccatgagatcgtcttcatcttaatagatgcagaacgattgtttatgtgttcaacatctatttgtgtgtggtttttttttcagcctcagaaaaatagtaatagatagaatcggtaaagtttttttgtttgttttgagacggagtctcactctgttgcccagcctggaatgcagtggtgcgatctcagctcactgcatcctccatctcctggagtcaagagattctcttgcctcagcctcccaagtagctgggaccacaagcgcacgccaccaggcccagctaatttttgtatttttaatagagatggggtttcaccatgttggccaggctggtctcgaactcctgacctcatgtgatccacccgcctcagtctcccaaagtgctgggattacaggggtgagacaccacgcctggccataagttattggcttgataaatgccattaatctacagcaaaaaccttactaaaagaagaaaatgtagacattcaccgcaaaatcaggaacaaggcaaggatgcccactgttacaatgccagcacaattctagatatccagatcacacaatttacaaaagaaatgtgagatataaacactggaaggaaaaagacacactcttatttaaaaagatgatatcgtcatctacaaaaaaccaatgaaaccaacagaaactaataaaactactcagaggagtaacaagttataagagcaacctacaaaaatcagatgttatcctcattaacaataaccaaatagaaaccaatatggactataagatgttacaatagcaactaaaaccattaagtagctaataattagcctcccacaaagacacatcagacccacaaaggaaaaattttagttctatcaaagaaactaaaaagaggtgtgatcaaatgggggagatttagcatcaccatggactggacaacttaatgttataaatatgctgatttttcatggaacaatttaaattcagtacaattcgaatcaaaattaaagtatgattttttccagaaattcaacaaaataattctgaagttttagctgagtatatttgaaaaggaataataaagtgagaggggagagggagctctctctcattctctctctcttcctctcactggctctctctctttctctccaccagatagtaagacccattggtaagccacagtaacaaaagcagaaaaaatgcaaatacaccaatgaaataaaatagctcagaaactggtccacttggatatatacaaacttggtgtagaattggcttcacatatggcagaaaaaatatactttttttattgtaaggtaaattgcctcactgtaaaggggataaaatgctaaagccaaatctatatctgactttctaggtagagcacatataaatagatgaggaaggggatcttcaaatcttattttaggaaataattatgatttgggtgtgaagaagggcatctttgaaatatctcaaaactacaaaccaacaaggtgaggcttgtggatttgaccttatcaatatcaaggatttttgatcaacagagactaccgttgtcagatttttgactgagaagaggttttactaaagtttaaaatcagcaatagtttgatacctagatagaaggaacttctgtccttgaatcaaaatcatgcagaaacaaggtgtgaaactcaatttaaaaagtagtcaaatgtcacaaaataagaaagggaagcccaaacggctagcaaatatgttgaaatgatcaaactcaccagctgtcagagaaatgaaaattaaaaataaaacgaactatctattgcattacaaccatcattcggacaaaaagtatgaaagtcaaaaatacttctaactgaagttgtggggaaattagaacacttgcagagtgtcattccagacagcagcttggtgatcctgggtgcatgtggggtctgtctctggtggccctgggtgcatgtggaggtctgtttctggtggcctctgatgaatgcggggtctgtctctgatggtcctaggtgaatgtgggtgttgtctctttctctggtggtcctgggtggatgtggggtgtgtctctgatggtcctgagtgaatgtgggtgtctgtcactttctctagtggccctgggtggaatatagtagccctgtctctattggtcttgcatgaaatgtagtgagcttatgtccactagtcctgggtgcagtgtgtttagcctctacatactcatcaactgctttattataagtccaggagggacgctgtccagcaggtaagtaaggaacacaggtgaaggtatcagtcgtgtggctgcatgtggtagaggaaaagagagcacaacctctgtccatcactatggtgacagagaagtaaaaggtggatgtattccacggaacactcctcaactgttaggacccctgagctagacatgtatacaacaataccgataaacctctaaaacaaaatgctgagcagaaaacccaagtagcaggatttctaatgctcactaaaacctctatgaacccagaaaccggaaacacaaaccagcacaatctgttctgcatgagcacatgtgtcttggaggactggaggacgcattgccaagcacctaggcatgggtgtctatgaggggaagagaaaggcagtaggcacaggaggtttgaagaaaactgatcatttaaaatatgaaagatcataaaatcagagctgtgccctgtaggaatcttgaaaatggtctgccatgaacttaggaatctaattagctcaaaggtcagagtcatgatcaagtaagataaaaggggtcagtacccacggctcattaccctgctcttaccaaacactgtgctctctctgataaaagccacgtctccagccccgtctctcagacacctgtgaaaagagaaaccatcaggggtaagcacaggcagccctccccagcccctccctgtggaacagtagccctggcactcagcatctatgggtttctactccctgcagggcagggctctgaagctt

SEQ ID NO: 2841 - DNA, 5133 bp; single-stranded, linear
cctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctacaacctggacgtgcggggcgcgcggagcttctccccaccgcgcgccgggaggcactttggataccgcgtcctgcaggtcggaaacggggtcatcgtgggagctccaggggaggggaacagcacaggaagcctctatcagtgccagtcgggcacaggacactgcctgccagtcaccctgagaggttccaactatacctccaagtacttgggaatgaccttggcaacagaccccacagatggaagcattttggcctgtgaccctgggctgtctcgaacgtgtgaccagaacacctatctgagtggcctgtgttacctcttccgccagaatctgcagggtcccatgctgcaggggcgccctggttttcaggaatgtatcaagggcaacgtagacctggtatttctgtttgatggttcgatgagcttgcagccagatgaatttcagaaaattctggacttcatgaaggatgtgatgaagaaactcagcaacacttcgtaccagtttgctgctgttcagttttccacaagctacaaaacagaatttgatttctcagattatgttaaatggaaggaccctgatgctctgctgaagcatgtaaagcacatgttgctgttgaccaatacctttggtgccatcaattatgtcgcgacagaggtgttccgggaggagctgggggcccggccagatgccaccaaagtgcttatcatcatcacggatggggaggccactgacagtggcaacatcgatgcggccaaagacatcatccgctacatcatcgggattggaaagcattttcagaccaaggagagtcaggagaccctccacaaatttgcatcaaaacccgcgagcgagtttgtgaaaattctggacacatttgagaagctgaaagatctattcactgagctgcagaagaagatctatgtcattgagggcacaagcaaacaggacctgacttccttcaacatggagctgtcctccagcggcatcagtgctgacctcagcaggggccatgcagtcgtgggggcagtaggagccaaggactgggctgggggctttcttgacctgaaggcagacctgcaggatgacacatttattgggaatgaaccattgacaccagaagtgagagcaggctatttgggttacaccgtgacctggctgccctcccggcaaaagacttcgttgctggcctcgggagcccctcgataccagcacatgggccgagtgctgctgttccaagagccacagggcggaggacactggagccaggtccagacaatccatgggacccagattggctcttatttcggtggggagctgtgtggcgtcgacgtggaccaagatggggagacagagctgctgctgattggtgccccactgttctatggggagcagagaggaggccgggtgtttatctaccagagaagacagttggggtttgaagaagtctcagagctgcagggggaccccggctacccactcgggcggtttggagaagccatcactgctctgacagacatcaacggcgatgggctggtagacgtggctgtgggggcccctctggaggagcagggggctgtgtacatcttcaatgggaggcacggggggcttagtccccagccaagtcagcggatagaagggacccaagtgctctcaggaattcagtggtttggacgctccatccatggggtgaaggaccttgaaggggatggcttggcagatgtggctgtgggggctgagagccagatgatcgtgctgagctcccggcccgtggtggatatggtcaccctgatgtccttctctccagctgagatcccagtgcatgaagtggagtgctcctattcaaccagtaacaagatgaaagaaggagttaatatcacaatctgtttccagatcaagtctctctacccccagttccaaggccgcctggttgccaatctcacttacactctgcagctggatggccaccggaccagaagacgggggttgttcccaggagggagacatgaactcagaaggaatatagctgtcaccaccagcatgtcatgcactgacttctcatttcatttcccggtatgtgttcaagacctcatctcccccatcaatgtttccctgaatttctctctttgggaggaggaagggacaccgagggaccaaagggcgcagggcaaggacataccgcccatcctgagaccctccctgcactcggaaacctgggagatcccttttgagaagaactgtggggaggacaagaagtgtgaggcaaacttgagagtgtccttctctcctgcaagatccagagccctgcgtctaactgcttttgccagcctctctgtggagctgagcctgagtaacttggaagaagatgcttactgggtccagctggacctgcacttccccccgggactctccttccgcaaggtggagatgctgaagccccatagccagatacctgtgagctgcgaggagcttcctgaagagtccaggcttctgtccagggcattatcttgcaatgtgagctctcccatcttcaaagcaggccactcggttgctctgcagatgatgtttaatacactggtaaacagctcctggggggactcggttgaattgcacgccaatgtgacctgtaacaatgaggactcagacctcctggaggacaactcagccactaccatcatccccatcctgtaccccatcaacatcctcatccaggaccaagaagactccacactctatgtcagtttcacccccaaaggccccaagatccaccaagtcaagcacatgtaccaggtgaggatccagccttccatccacgaccacaacatacccaccctggaggctgtggttggggtgccacagcctcccagcgaggggcccatcacacaccagtggagcgtgcagatggagcctcccgtgccctgccactatgaggatctggagaggctcccggatgcagctgagccttgtctccccggagccctgttccgctgccctgttgtcttcaggcaggagatcctcgtccaagtgatcgggactctggagctggtgggagagatcgaggcctcttccatgttcagcctctgcagctccctctccatctccttcaacagcagcaagcatttccacctctatggcagcaacgcctccctggcccaggttgtcatgaaggttgacgtggtgtatgagaagcagatgctctacctctacgtgctgagcggcatcggggggctgctgctgctgctgctcattttcatagtgctgtacaaggttggtttcttcaaacggaacctgaaggagaagatggaggctggcagaggtgtcccgaatggaatccctgcagaagactctgagcagctggcatctgggcaagaggctggggatcccggctgcctgaagcccctccatgagaaggactctgagagtggtggtggcaaggactgagtccaggcctgtgaggtgcagagtgcccagaactggactcaggatgcccagggccactctgcctctgcctgcattctgccgtgtgccctcgggcgagtcactgcctctccctggccctcagtttccctatctcgaacatggaactcattcctgaatgtctcctttgcaggctcatagggaagacctgctgagggaccagccaagagggctgcaaaagtgagggcttgtcattaccagacggttcaccagcctctcttggttccttccttggaagagaatgtctgatctaaatgtggagaaactgtagtctcaggacctagggatgttctggccctcacccctgccctgggatgtccacagatgcctccaccccccagaacctgtccttgcacactcccctgcactggagtccagtctcttctgctggcagaaagcaaatgtgacctgtgtcactacgtgactgtggcacacgccttgttcttggccaaagaccaaattccttggcatgccttccagcaccctgcaaaatgagaccctcgtggccttccccagcctcttctagagccgtgatgcctccctgttgaagctctggtgacaccagcctttctcccaggccaggctccttcctgtcttcctgcattcacccagacagctccctctgcctgaaccttccatctcgcccacccctccttccttgaccagcagatcccagctcacgtcacacacttggttgggtcctcacatctttcacacttccaccaccctgcactactccctcaaagcacacgtcatgtttcttcatccggcagcctggatgttttttccctgtttaatgattgacgtacttagcagctatctctcagtgaactgtgagggtaaaggctatacttgtcttgttcaccttgggatgacgccgcatgatatgtcagggcgtgggacatctagtaggtgcttgacataatttcactgaattaatgacagagccagtgggaagatacagaaaaagagggccggggctgggcgcggtggttcacgcctgtaatcccagcactttgggaggccaaggagggtggatcacctgaggtcaggagttagaggccagcctggcgaaaccccatctctactaaaaatacaaaatccaggcgtggtggcacacacctgtagtcccagctactcaggaggttgaggtaggagaattgcttgaacctgggaggtggaggttgcagtgagccaagattgcgccattgcactccagcctgggcaacacagcgagactccgtctcaaggaaaaaataaaaataaaaagcgggcacgggcccggacatccccacccttggaggctgtcttctcaggctctgccctgccctagctccacaccctctcccaggacccatcacgcctgtgcagtggcccccacagaaagactgagctcaaggtgggaaccacgtctgctaacttggagccccagtgccaagcacagtgcctgcatgtatttatccaataaatgtgaaattctgtccaaaaaaaaaaaa

SEQ ID NO: 2842 - DNA, 1388 bp; single-stranded, linear
ggatccagaagggtcattcaatcagttctcagtcttatcaggtctaagttcctttcttatcaggtcctaaaggcctaatcttatcattgtgacaaagataactgtagagtctgttaaactttttttttaataacatgaagattatgatttatagctgaatttctcccttttattccaattcaacaattttcatggctttttgtgtttgttttgttctggacatatttacagaaaattacctgaagagttccaacctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagctttcttctggccattactacacaattgtcacattatcagtgacttttctgtttggctacaacacgggcctctatctgctgacggccattagtgtggagaggtgcctgtcagtcctttaccccatctggtaccgatgccatcgccccaagtaccagtcggcattggtctgtgcccttctgtgggctctttcttgcttggtgaccaccatggagtatgtcatgtgcatcgacagagaagaagagagtcactctcggaatgactgccgagcagtcatcatctttatagccatcctgagcttcctggtcttcacgcccctcatgctggtgtccagcaccatcttggtcgtgaagatccggaagaacacgtgggcttcccattcctccaagctttacatagtcatcatggtcaccatcattatattcctcatcttcgctatgcccatgagactcctttacctgctgtactatgagtattggtcgacctttgggaacctacaccacatttccctgctcttctccacaatcaacagtagcgccaaccctttcatttacttctttgtgggaagcagtaagaagaagagattcaaggagtccttaaaagttgttctgaccagggctttcaaagatgaaatgcaacctcggcgccagaaagacaattgtaatacggtcacagttgagactgtcgtctaagaactgtgagggaagttgtggataaaaatggtggaacacaggtcatttttagtttgtgcttggaatatgacttaagtatctcctaaatgtgatacagaagaacatctcatcccatatgcatgagatactaattaatgatgaaa

SEQ ID NO: 2843 - DNA, 393 bp; single-stranded, linear
gagcagtgcccagcttgtcgcagatattgaagccgtgtaaaataaatgcctttgattgttcacactttaagcaatattggtacaatattaaacccattgtcccaggcactccctctccttactgcttatggcacttcatgtattaaaaaatgacagtggcagcattgcccagacatgcgttttgtcatcaagtcttaatgcagtccacctggtccctcaggcaaatgaatggaggcacagaagatgaaatgattttcaaaatgccattaggaaagctcaggccagaactggaaatgggtcccgcacagggcactcggccactcttgcctggccatctcctttttggcactaagcacacaatgatatagaatgaatggttatcactggggatcc

SEQ ID NO: 2844 - DNA, 1388 bp; single-stranded, linear; identical to SEQ ID NO: 2842

SEQ ID NO: 2845 - DNA, 3169 bp; single-stranded, linear
ggatccagaagggtcattcaatcagttctcagtcttatcaggtctaagttcctttcttatcaggtcctaaaggcctaatcttatcattgtgacaaagataactgtagagtctgttaaactttttttttaataacatgaagattatgatttatagctgaatttctcccttttattccaattcaacaattttcatggctttttgtgtttgttttgttctggacatatttacagaaaattacctgaagagttccaacctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagctttcttctggccattactacacaattgtcacattatcagtgacttttctgtttggctacaacacgggcctctatctgctgacggccattagtgtggagaggtgcctgtcagtcctttaccccatctggtaccgatgccatcgccccaagtaccagtcggcattggtctgtgcccttctgtgggctctttcttgcttggtgaccaccatggagtatgtcatgtgcatcgacagagaagaagagagtcactctcggaatgactgccgagcagtcatcatctttatagccatcctgagcttcctggtcttcacgcccctcatgctggtgtccagcaccatcttggtcgtgaagatccggaagaacacgtgggcttcccattcctccaagctttacatagtcatcatggtcaccatcattatattcctcatcttcgctatgcccatgagactcctttacctgctgtactatgagtattggtcgacctttgggaacctacaccacatttccctgctcttctccacaatcaacagtagcgccaaccctttcatttacttctttgtgggaagcagtaagaagaagagattcaaggagtccttaaaagttgttctgaccagggctttcaaagatgaaatgcaacctcggcgccagaaagacaattgtaatacggtcacagttgagactgtcgtctaagaactgtgagggaagttgtggataaaaatggtggaacacaggtcatttttagtttgtgcttggaatatgacttaagtatctcctaaatgtgatacagaagaacatctcatcccatatgcatgagatactaattaatgatgaaagagcagtgcccagcttgtcgcagatattgaagccgtgtaaaataaatgcctttgattgttcacactttaagcaatattggtacaatattaaacccattgtcccaggcactccctctccttactgcttatggcacttcatgtattaaaaaatgacagtggcagcattgcccagacatgcgttttgtcatcaagtcttaatgcagtccacctggtccctcaggcaaatgaatggaggcacagaagatgaaatgattttcaaaatgccattaggaaagctcaggccagaactggaaatgggtcccgcacagggcactcggccactcttgcctggccatctcctttttggcactaagcacacaatgatatagaatgaatggttatcactggggatccggatccagaagggtcattcaatcagttctcagtcttatcaggtctaagttcctttcttatcaggtcctaaaggcctaatcttatcattgtgacaaagataactgtagagtctgttaaactttttttttaataacatgaagattatgatttatagctgaatttctcccttttattccaattcaacaattttcatggctttttgtgtttgttttgttctggacatatttacagaaaattacctgaagagttccaacctgaggcctcctcatggatgggtcaaacgtgacatcatttgttgttgaggaacccacgaacatctcaactggcaggaacgcctcagtcgggaatgcacatcggcaaatccccatcgtgcactgggtcattatgagcatctccccagtggggtttgttgagaatgggattctcctctggttcctgtgcttccggatgagaagaaatcccttcactgtctacatcacccacctgtctatcgcagacatctcactgctcttctgtattttcatcttgtctatcgactatgctttagattatgagctttcttctggccattactacacaattgtcacattatcagtgacttttctgtttggctacaacacgggcctctatctgctgacggccattagtgtggagaggtgcctgtcagtcctttaccccatctggtaccgatgccatcgccccaagtaccagtcggcattggtctgtgcccttctgtgggctctttcttgcttggtgaccaccatggagtatgtcatgtgcatcgacagagaagaagagagtcactctcggaatgactgccgagcagtcatcatctttatagccatcctgagcttcctggtcttcacgcccctcatgctggtgtccagcaccatcttggtcgtgaagatccggaagaacacgtgggcttcccattcctccaagctttacatagtcatcatggtcaccatcattatattcctcatcttcgctatgcccatgagactcctttacctgctgtactatgagtattggtcgacctttgggaacctacaccacatttccctgctcttctccacaatcaacagtagcgccaaccctttcatttacttctttgtgggaagcagtaagaagaagagattcaaggagtccttaaaagttgttctgaccagggctttcaaagatgaaatgcaacctcggcgccagaaagacaattgtaatacggtcacagttgagactgtcgtctaagaactgtgagggaagttgtggataaaaatggtggaacacaggtcatttttagtttgtgcttggaatatgacttaagtatctcctaaatgtgatacagaagaacatctcatcccatatgcatgagatactaattaatgatgaaa

SEQ ID NO: 2846 - DNA, 3585 bp; single-stranded, linear
gggcccagagaaagagctgtccccggggccttggggacagggtgacagccacccagagatcatggagaaggggacgtaaggaagacctcacagaggagtcatcctgcgactgtgttggttgggtccttcaggaagcagagtcccaggagttggaagcataagaggaatactgcgggcaatgcctgagaaagataacagggaccgggagcaggagtgagttgggcaggggaaggatcaggcccacaatgccaggctcacacctgcagaggagggaagaagaagaagggcctcacatcagcccagcgggggatgttacgcccacagacgccccggggctcagttactgtctaagtgttagaaataaattttcggtgccacaaaagaaatagcactcagattaaatgttcccagcaaggcaattttacttctatagaagggtgcatctcacagatggagcaatggcaagagcacacctgaacaagggaagggaaggggtttttatccctaaggcaggtagcccctacagctgtgttgttcccctattggctagggttggaccacaccgtctgagctaattgttactggctattttaaagagagcaggggtaagagccggattggcagggtaagtagtttggcaggaaggacggtcacagaacaggtgactcaggatgactcaggtcagagcaggtgaccagtggtgactcagttcggagcaggtgatagaagctaggagggggttgtttactgaaactaggggcaaggagacgaagagaacatgaaagttaaactttaagatgaagaacaaagctgaacatactgatgcattggatctttggagaggatctcagaactcattgtacttaatttacaggctaaaaccttagaagaggaatttattatatcctacacaagactccagggaagcacatggccttggactgaaggctggcatctggaagctgtcagccaccagcaccttctgcagcaggtacctgctctctaagagggaggcctgggtggtgcacctccagagctgcccaggctgggcctcaaggaagaaaaagattttcatttgtcagaggcggaagggagaggtggagggaacagcacagcagcggcccaggggcagggaagcacaggaccattagggagacacgagaaagcccatttgtctagaacagaggattcaagcagtgcaccaaggaaaatgagggccaggccaatgtgctggagtggctttgttcttggctgagggttttgggtagtgccaaagcgtaaggtaagccctgctttccagaagaatctagcagagtgtggagcccagatgggactggaaggcctgggaggggtcaggtggccacagggacgggccacagccagtggtgcaggcaagaagacaatggccatccatggtggctcacacctggaatcccagcccattgggaggtcgaggcaggtggatcacctgaggtcaggagttcgagaccagcctggtcaacatggtgaaaccctgtctctaataaaattataaaaattagccgggcgtggtggtgggtacctgtaatctcagctactcaggaggctgggtcaggagaatcgcttgaacccaggaggcggaggttacagtgagctgagatagcaccattgcattccagcctggacaacaaaagcgagactctgtctcaaaaaaaaaaaaaaattagccaggcgtggtggtgggtgcctgtcgtcctcgggaggctgaggcatgagaatcactccgggaggcagaggttgcaatgaaccaagatcacaccactgcactccagcctgggtgacagagcaagactctgtctaaaaaaaaaaaaaagacagaaggatgtcagcatctgatgctgcctgtcaccttgaccctgaggatgccagtcacagctccattaactgggacctaggaaaatgagtcatccttggtcatgcacatttcaaatggtggcttaatatggaagccacacttgggatctgttgtctcctccagcatggtagaagatgcctgaaaagtaggggctggatcccatcccctgcctcactgggaaggcgaggtggtggggtggggtggggcctcaggcttggggtcatgggacaaagcccaggctgaatgccgcccttccatctccctcctcctgagacaggggcagcagggcacactagtgtccaggagcagcttatgaggccccttcaccctccgatcctccaaaactggcagaccccaccttcttcggtgtgaccccagagctctgagcacagcccgttccttccgcctgccggccccccacccaggcccaccccaaccttatcctccactgcttttcagaggagtctggccaacacaaatcctcttgtttgtttgtctgtctgtctgctgctcctagtctctgcctctcccagtctctcagcttccgtttctttcttaaactttctctcagtctctgaggtctcgaaatcacgaggcttcgacccctgtggaccagatgcccagctagtggcctttctccagcccctcagatggcacagaactacaaaccccagcatgcactctggcctgaagtgcctggagagtgctggtgtaccccacctgcattctgggaactgtagtttccctagtcccccatgctcccaccagggcatcaagctcttccctggccggctgaccctgcctcagccctagtctctctgctgacctgcggccccgggaagcgtgcgtcactgaatgacagggtgggggtggaggcactggaaggcagcttcctgctcttttgtgtcccccacttgagtcatgggggtgtgggggttccaggaaattggggctgggaggggaagggataccctaatgtcagactcaaggacaaaaagtcactacatccttgctgggcctctatccccaagaacccaaaaggactcaagggtggggatccaggagttcttgtatgtatggggggaggtgaaggagagaacctgcatgaccctagaggtccctgtggtcactgagagtgtgggctgccatcccctgctacagaaacggtgctcaccttctgcccaaccctccagggaaaggcacacaggggtgaggccgaaccttccgtctggtgccacatcacagaaggacctttatgaccccctggtggctctaccctgccactccccaatgccccagcccccatgctgcagccccagggctctgctggacacctgggctcccacttatcagcctcagtcctcacagcggaacccaggcgtccggccccccacccttcaggccagcgggcgtggagctgaggctttagagcctcccagccgggcttgttcctgtcccattgtgtatgggataggggcggggcgagggccagcactggagagccccctcccactgccccctcctctcggtcccctccctcttcctaaggaaaaggccagggctctgctggagcaggcagcagagtggacgcacagtaacatgggcaacttgaagagcgtggcccaggagcctgggccaccctgcggcctggggctggggctgggccttgggctgtgcggcaagcagggccc

SEQ ID NO: 2847 - DNA, 19062 bp; single-stranded, linear
ggatcccatgccctgcctcactgggaaggcgaggtggtggggtggggtggggcctcaggcttggggtcatgggacaaagcccaggctgaatgccgcccttccatctccctcctcctgagacaggggcagcagggcacactagtgtgcaggagcagcttatgaggccccttcaccctccatcctccaaaactggcagaccccaccttcttggtgtgaccccagagctctgagcacagcccgttccttccgcctgccggccccccacccaggcccaccccaaccttatcctccactgcttttcagaggagtctggccaacacaaatcctcttgtttgtttgtctgtctgtctgctgctcctagtctctgcctctcccagtctctgagcttccgtttctttcttaaactttctctcagtctctgaggtctcgaaatcacgaggcttcgacccctgtggaccagatgcccagctagtggcctttctccagcccctcagatgacacagaactacaaaccccagcatgcactctggcctgaagtgcctggagagtgctggtgtaccccacctgcattctgggaactgtagtttccctagtcccccatgctcccaccagggcatcaagctcttccctggctggctgaccctgcctcagccctagtctctctgctgactgcggccccgggaagcgtgcgtcactgaatgacagggtgggggtggaggcactggaaggcagcttcctgctcttttgtgtcccccacttgagtcatgggggtgtgggggttccaggaaattggggctgggaggggaagggataccctaatgtcagactcaaggacaaaaagtcactacatccttgctgggcctctatccccaagaacccaaaaggactcaagggtggggatccaggagttcttgtatgtatggggggaggtgaaggagagaacctgcatgaccctagaggtccctgtggtcactgagagtgtgggctgccatcccctgctacagaaacggtgctcaccttctgcccaaccctccagggaaaggcacacaggggtgagccgaaggcccttccgtctggtgccacatcacagaaggacctttatgaccccctggtggctctaccctgccactccccaatgccccagcccccatgctgcagccccagggctctgctggacacctgggctcccacttatcagcctcagtcctcacagcggaacccaggcgtccggccccccacccttcaggccagcgggcgtggagctgaggctttagagcctcccagccgggcttgttcctgtcccattgtgtatgggataggggcggggcgagggccagcactggagagccccctcccactgccccctcctctcggtcccctccctcttcctaaggaaaaggccagggctctgctggagcaggcagcagagtggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacaggtaagggccaggcagctaggagcaggtgggcaacaagggtggtgtcaaggcctgaagcctggggctgggaaggtctggaacttgtagctgagtcgggagggccaggtcacaaatgcaaaagggctattaatgtgcatagaacaggacagtctgggaggctcagaaaggagaccaggatcagagtcggcaggtgaagctgggagtaagggtgccagctatagaatctggccagggtttgaatgctgctctgccgccaggagctgtttgactttgagcaagttacttaatctctctgaacctccatttatataaaacgagatatggcaatacttactccatggggaagtaagtttctagctcacagcaagccttcaacagcagcgatgattatttagctggagaagaaaggagctgacagcagtggttacaggagtgagaaagtggggtctcccagaagagggagagagttgggcaggaaactcgggcccttggggtaagcaggctgagaagacagagccaccaggcttttttcccctgctccagccccctctcctcgtggctgtcacccgaaaactggaccatgcagttcccacaagagtcctcccgggggtagaggtcccaggagggaggaaagacccggaggcctggtggggtgccaggccgggggcaggctggggctgcaggcagctatgcagggaaggctgagggccggggccctgctgctcaggcgcacccttggcctgagtccctcccttcctccctgccgctggtggctctgggaggaagtgataaggcctgcgaggcttcccttcacacatggggctgctgtcaggaggggttgtgagtgcggagggaaatcagagctgaggaatccctgcagggcttccctccactcaagcaccaggctctgtccccctcagggtagggcttatagcagctttgcggggggtggacaccccatctccagaagaggtgaggtgggcgctgcaggtgggatgcgaacttagcctcgggtcaggggctcaggagctcagcaccagcagcccctgcagcccaggaccctggtctataaacggaggcacagctcgcctctagctcctaaggcatggggaacgccagaaggcatgcggcaggtgggctgtgagatcgccagtgctgtaacaggggcctccgggtgacatctgggaaggctgaaaggaaacaaacccttcctgatgaccctatccctggctcccaacagccccccgagctccccgctaacccagcccccagaggggcccaagttccctcgtgtgaagaactgggaggtggggagcatcacctatgacaccctcagcgcccaggcgcagcaggtaaggccggcatgccctgtccccatcgtctccagggaaagggtgggtaaggcctggcctcagatggggccggagagggaagctcaacccttctttgaattggtcccttgtttccaaaaagaggagaggactgggaagaaccagaggagttgagggacatgcacgggacttgggtgaccctcagcctccagccttacccccaaccctggctcaaacttttcccccatcccacccctgcaccccttttccccctcccacccctgcacccttcctccctctcccccaccccacccctgccccccctcccatcccagctctaaacccctcctccctctcccccgtcccacccctaaaccccacctccctgtccccctctaaacccctcctccctgtccccctctaaaccccacctccctctccccatcccacccctgcacccttcctccctctgcccccgtcccacgcctgtactcctcctccctctcccccgtcacacccctgcacccctcctccctctccccatcccatccctgcacccctcctccctctgcccccgtcccacccctaaacccctcctccctctgccccaccccacccttgcacccctcctccctcttcccccgtcccctgcctgcattcctcctccctctccccatctcacccctgcacccctcttccctctcccacccctgcacccctcctccctctccccgtcccaccctgcactcccgccctctccagcgtcccacccctacacccctcctccctctgccccattccacccctgcaccccctcctccctctgccccgacccacccctgcacccctcctccctctcccccgtcccacccctgcatccctcctccctctgccccgtcccacccctacacccctcctccctctcccccatcccacccctaaacccctcctccctctcccctgtcccatccctgcacccttcctccctctccccgtcccatccctgcacccttcctccctctccccgtcccatccctgcacccctcctccctctgctcccatcccacccctgcacccctcctccctctgcccctaccccacctctgcacccctcctccttctccccatcccacccctgcacccctcctccctctgcccctaccccacccctgcacccctcctccttctccccatcccacctctgcacccctcctccctctcccctctcccacccctgtacccttcctccttctccccgtcccacccctgcacttctcctccctctaacccatcccacccctgcacccttcttccctctcccccatcccaccactgcacccctcctccctctccccctgttccacccctgcacccctcctccctgcccccaactcccatcccacccctgcaccctggcctgtcctgacctttgcactccctcgacccaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggtgacagcttcccggacgccacagcctcccttgtcccactgaggccccagaaaccccgtgacgaccttcccatgaccccctcccttcccagatcctaacaccacgtgggcccctcccgccctcccccagcacttgcacaaagcctggaggagggcctccctgtcccacacaacttcctgcttgtccccttcccacccctctcctccccaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgcggctggccagcgactgagagacccgggcgctaccaaaaggggagcggggtggcggggcagttcctaaggcttcccgggggctgggaggtcccaaactgtgggggagatccttgccttttcccttagagactggaaaggtagggggactgccccaccctcagcacccaggggaacctcagcccagtagtgaagacctggttatcaggccctatggtagtgccttggctggaggaggggaaagaagtctagacctgctgcaggggtgaggaagtctagacctgctgcaggggtgaggaagtctagacctgctgcaggggtgaggaagtctagacctgctgcgggggtgaggaagtctagacctgctgcgggggtgaggacagctgagcggagttccctgggcggtgctgtcagtagcaggagcagcctcctggaaaagccctggctgctgcttctcccccaagagagaaggcttctcccgccaggccagtccagtgcagcccctcacccacacccactgctaccccagttcccctgcttcggcccgcaccctccctcacaccccagcccacagactcggggctggccttagttactggaacgcctgtgaccacagcactaagagaagcaagctgccccatgggggacttggtccccatggccttggcctccttcaccatcactggccgccaaagagtttgaaataaagccacgtgcccagtgaatcccaaaggaacctcaactaaaataaaaacaatcctatctgacacttgcctgaccctctaagtcattcaaagctttagctcaacttcgatccatctgagctgccatagtggaccccactcagagctgcgtccctcccttgaccccaggttggtccctgccactcccctgcccctgtcactgacacatgtttcctcctccctcaggcaggagtgggacctcccagcctcctcctggggcctccactcagaatgtcaggatgagcagggtcctaggaggcctctggtgcagccttcccttcccaccatccatgtgctcaaagagaatcacccgtcctttcttgaatgccatggatcatgggggatttgctgcccacactcctaggcggcctcttagacatccgttggtgcctaacccaagcatcagtttggcagaggccgagtccctcctctgtactggataccaagtcagcttccatagggatggggagacacctggcccagggaggagatgagaagcagcccggatggtgctacatatgtcagagagcagggcaggaagggatcagtgtggctgccaatggtcaggagggcgccatggagtgaaccatggcccctgcctcctcaaccaagaagtcctctggagctgatactcaagaccccccgtctctctcctcaccctcctctcccgctgcctcggctggctcaggtgttcgatgcccgggactgcaggtctgcacaggaaatgttcacctacatctgcaaccacatcaagtatgccaccaaccggggcaaccttcggtgagtgccccccaccatgccaggccccagccttcttccccaaggcagggaaggcggggctctgaccagctctttccccatgcgtgccagctcggccatcacagtgttcccgcagcgctgccctggccgaggagacttccgaatctggaacagccagctggtgcgctacgcgggctaccggcagcaggacggctctgtgcggggggacccagccaacgtggagatcaccgaggtgggcaccgagggccacccatgagggtgtccccaaggtggagaatgaggaaaccagtgggagaaggctcgggggatccaggcaggaagaggggagcctcggtgagataaaggatgaaaaacaccaaaggaggggtgcctgggtggtcacggagacccagccaatgagggaccctggagatgaaggcaggagacagtggatggaggggtccctgaggagggcatgaggctcagccccagaaccccctctggcccactccccacagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgtgagcaccaaagggattgactgggtgggatggagggggccatccctgagcctctcaagaagggcctgcaagggggtgctgatcccacaccccaacacccccaggctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggtgaggtgcgggatggggctcgggcaccgaatgcacctgtccaaggcaggagtctggctctcactccatccccaaaatgccagccacggggacaatcagagcaggtccagggttgcctcctaaatgggaactgaggacaagctctagaaccactgaagcaaaggggtagggggtggcaggggtgtgtgtgggggtgtgagtgggtgagtgtgagagtgtgggtttctggggtgtgcagtgggtgagagtgtgggcttgtggggtgtgtagtgggtgtgagactgtgggtttgtaggggtgggtgagtgtgggtgtgtgggggtaggtgggtgtgggtttgtgggtgtgtataggcagtgactgtgagactgtgggtttgtgggggtaggtgactgtgggtttgtggggtgtgtaggggtgagtgtgtgtgggtttgtaggggtaggcgagtgtgggtttgtggggtgtgtaggggtgagtgtgtgtgagtttgtaggggtaggcgagtgtgggtttgtggggtgtgtaggggtgagtgtgtgtgagtttgtaggggtaggtgagtgtgggtttgtggggtgtgtagggggtgtgtgtgggcttgtaggggtaggcgagtgtgggtttgtggggtgtgtaggggcgagtgtgagagtgtaggtatgtgggtgtgagtgtggatgtgtgtaggcggtgagtgtgaaattgtgggtttgtgggggtgggtgggtgtgagtgtgtgggtttgtgggtgggtgtgggtgtgagtgggtgggtgaggggggcatggggatgggtgtgaacatgtagttgttctttcaggcataggacccatagctctagagctttcatcagattctcaaaggggaccttgactcggaaaaggttaagacccattttagagatgagaaattaaagcctggagctgaggagcgactggcccaaagtccctctctgctctgaggtgcttcgcaggcaaaaacctgaaccagccccctaggcagccaggcctcccaatggacaccactcacctcactccttccagccatgtacgggaaacagagatagtctccccaccccacccccgtgatcacctctgtccctaccgatgccacacacccttctgccccaggatgtggctgtctgcatggacctggatacccggaccacctcgtccctgtggaaagacaaggcagcagtggaaatcaacgtggccgtgctgcacagttaccaggtgcagaggcccagactggccaggaaggcaaagggtttgcatacgggggcagcaggggcgggggatggaggagaggcagccatttagaaactagggcaggatttggacaggcagaagaagttccgtagtcccagtgccatggcgcacactggctgcggttcggggacagggcaggtactattccaggcgctgtcatctggtggcttactgtgtgccagggaccttgctgtttactgcatgcccagtcatgctgattctcagggcatattgggtattgcagtttgtgggacccgctggatcctggaaacaaataccaggatcaagggcacaccaggagtcgtagtttgaggaagccggggcctgctgagaatttctgtgggctatttggtttggggaccaggcatgcagatgctggagattagagctgcttgttgcatgttgaacctgcagcatgaccatgcatgatgtggtttggggtgagggtgacattgtggtttgaggggacacagggtgtgttagatatggggtaatcgagggcacatgtggtttggggtgaccggagtggtggaggaagaatgggcgaggtctgtgggtctggtttgagcctctccccctctctctcccttccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccaggtgcccaccctaatggctctgccagcctgggcccagctctaattctaagcagcccctggggacctctaacctttccttttctttacctcccctcccaaccccatcatctctctgcagccagacccctggaaggggagtgccgccaagggcaccggcatcaccaggaagaagacctttaaagaagtggccaagtgggtcccctgggagccccgctctcccacacacaccctgggggccccactctcccccacacaccctgggggaccctgccccagcagtgttctggacctaccactcagtatcccaaaaccctgttgtgagggggttggacccttgcctggggaggccctgcctctgtgcacccgggacaccctcacaccttcctctcccgcagcgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtagggctgagcccaggggagcagggagctagaaagagggggctctatcagcatcttcaggggtgccctggaggacaggaagtgttacaagtcaggactcatgaggaacccggaaccacaggtgttcagagatcaagttggggcctgaatcttgcactgccagggaggccagagtgaggagggcagggcctccgggggccacagcacccaggacatctgtcttcccacccacaggtcctgtgtatggatgagtatgacgtggtgtccctcgaacacgagacgctggtgctggtggtaaccagcacatttgggaatggggatcccccggagaatggagaggtgagaacttccaggaaaggggctgctgggaatgaggagagactcagaattggagtgactgggcaggaacctctgcccaacacacacacacacacacacacacacacacacacacacacacacacacacacacacacacacacacacacacgccaggatggaaagggagatgctaagagacccctggagcctgaaaccccacacaacgtacgctcccagcccacccatgtggctgcctccctgcaagcacatttgcttaactgcgcgtccccaagtcatttccattatcagtgcaagtttttaatacaaggaaggcacatcctggctgaccaagaggttagactgtgctcgggcactgacaagaaaaacagggatacgtcactgagggcggcttctaggatgcgggtaatgtttcttaatgggatactggttacacaggtgtgttcagtttgtaaaaatccacagagctgtacatttacaacatgtacaacactattccagcattttattttatttgttttatttattttgataacctatttacgttgcccaggctggccttgaactcctagcctcaagagatcctcctgccgcaggctcctttttcaaaagaagaaattgagcgctgtttagatgccaacatagattaaataacttcactttttaaaaagaaacacaaagctagagtaccatcattgaattccttctcttgcaagcttaggtatctctgaggtgccccaggctaggctcatttctgagtcttacctgctccagcttctaggtgttaaaggccttattagcactaagtacttcctcagtactcttttttcttttttcctttgagacagggtctcactttgtggcccaggctggagtgcagtagtacaatcacggctcactgcagcctcaacctcctagactcaagcaatcctcccacttcaacctcccaagtagttgggactacaggcgcatgccatgatgcctagctaatttttgtattttttatagagatggggtttcgccatgttgcccaggctggtctctaactcctgggttcaagcaatccacctgcctcggcctcccaaagtgctgcgattatagacgtgagccactgcacctggcccgcagtatcttaagcaagttggaatctcgtgaaaccctttttgctgccttagtgtccgtttcagccctcattcttacctaccttttcaagaaaaatagcaccagcaattgacttttttttagcataaaggtgtatagaacccatataacctacagccttcacaaggcatagcacattttcaccaccctggaaagttccctcatcagttcctcacgtgaatcccttcccagtctgtctccctgccagaagtgtctgtcaccacagaatagtttcgcctgctctagaacggcacctagatggaagcacgcagtgttgcggcgtctcctgctgaggctgtttttgaggcgcactcgtgttgctgcgtgactcagtatttcactcattctgctgctgagtgccgttcattgtgtgaatatccccagtttgtttacccattctcttgttggtgacacttgggctgtttccaggtcggggctattatgaataaacctgttatgaacattctgtacccggcttttgtgggcttatgtttttatttctcttgggtaaaacctaggagtagaattggtaggtcatagggtagatgcatgtttaatctttcacttttttaaaaaataaaactgccaggccaggcgcggctgctcacgcctgtgatcccagcactttgggaggcccaggtgggtggatcacttgaggtcagaagctcaagaccagcctggccaacatggcaaaaccctgtctctactaaaaatacaaaaattagctgggcatggtggcgcacgcctatagtcctagctactcaggaggctaggcgggagaattgcttgaacctgggaggtggaggttgcagtgagccgagatcacgccactgcactccagcctgggtgacagagcaagaattctacttaaaataaaatacaaataaataaaataaaactgtcaaacagcaaagcaaattaaactgccctttaacatctgtgcagttcaatgtatgttaattttatcccaaatttttaacaaatctaggaatacagctcacagaaaatggggtatattcactaaaaataaggaatatttatagcaaatttgtttgtaataccccacactggaaacaattcaaatgaccatcgacaaatactgataaattgtggtatattcaagtgccatatcgcactaagtgtgaacgaaacacaaccacacacaacagtgcaggtgaatctgaaaaaatgtgaagagaagaaaaagccagaccaaagaatacatactgtactacagggttcactttatataaagttcagaaacaggcagaactaatccacggagttagaaattaggagaggagttagtcactgggatgggggtggcagtgacaggaagaaggcacgaagttggcttctaggatgcgggtaatgtttgtttgtttgtttgtttgtttgtttttgtttttgagctggagtctcactctgttgcccaggctggagtgcaatggcgtgatctcggctcactgcaacctccgcctccccggttcaagcgattctcctgcctcagcctcccgagtagctgggattacaggtgcccgccaccatggccagctaatttttgtgtttttagtagagacgcgtttcaccatgttggccaggctggtcttgaatccctgacctcagcctcccaaagtgctgggattacaggcgtgagccaccacgcccagccacgggtaatgtttctcgatgggatgctggttgcacaggtgtgttcagtttgtgaaaacttacagagttgtacatttacaacatgtgtgcacctctggacttgtgttgcacgttgacaaaacattcaaaaatgaaattcaaatcgttcttgctaactctggcgcacttgggaaccagcacccagaggcatctgcagttgagcaccagatgcagttccttccagcttccttccccctgggaggtccgcttgatgccacttcttcatggcagcacaaacaaggccatggtcttctgaggagggcaacctgcacaatgtctgctagtgaccaggacactgctgaaggaactgagagtttgtccacccatgaaatccactaaaacaggaaagattttgctctagccgttgttagccaggagtgaggaaagagctgtgccctcccctgcagctgcgaggacgatctgcctgccccaacaagtggggattcagcaactccacttctaaggattacccagctgaagcatttaaaagtgggagcaaggcacacgtacaagggcgtttgagagagcacctgttcccagaccaccgagctgcccttcagtctcagtgaagtacaatgtagccactaaaaagactgaggtcatgttttggaaagtccaggccggaggatcgcttgagcccaggagttcaaggccagactgaacaacacagcgagactccatctcttcagaaaatttaaaaattaaccaagagtggtggcacgcacctatagatctagctactaggaaggcagaaaaatcccttaagcccaggagtttgaggttacagtgaatgatgatggagccactgcaccccaacctgggcgacagagcaagacccatatctaaaaacaatactactacttacgtcaatattgttgtattgacctggagggatgtctgcaataaattattgattaaaaccaaggaagtacagtatggtaccacttttacttaaaaaaaaactataaatatgcacgtgcacgtaagttcaaggaaaaagggctggaaggttaacacctgtgaatggcgcatatgcccggaggaagatggggtggtctttgtcttatcactttacacatttctgtaatgtcatttttcaaaaacatcagatcgcttttgaaattttcaaaacaaataaaaattaagtgacaaatcaataataatgaggatcagctggtacagttttaaacttctatgtagtttgaaatgaaacaaaactaaccctgatgcaaacactcccctcgccagagctttgcagctgccctgatggagatgtccggcccctacaacagctcccctcggccggaacagcacaagtgagttgggtgagagtttgggggagctgggggagctgatgcatttggagacacaaacagaaagggggtctgaaaagctctccctctgtgcctcaagtcgttttcccaccaaaagccagggctccaggatgccctccattccaggctgcaatggcagtccagacctgcctgcttctgagagccgggacagtcctgaggtcttcagagatgggggtgtggtgtgtcagggccccaggctcggaaccccagggatgctggccctcagcccctcccaagggcagggcctttcctgtccagaggcagagaccctgaagccgtccctggggctgggtctgggcctagcctgtatccccagggccctgtgacaaccttgtctttgtcctctcttgccaggagttataagatccgcttcaacagcatctcctgctcagacccactggtgtcctcttggcggcggaagaggaaggagtccagtaacacagacagtgcaggggccctgggcaccctcaggtcagggcctcaccaagaggggtgcaacgggtgggcaagctgcctgggcaaacgtggcctgcaaagggagctccactgacgacccctgcaccccaggttctgtgtgttcgggctcggctcccgggcatacccccacttctgcgcctttgctcgtgcggtggacacacggctggaggaactgggcggggagcggctgctgcagctgggccagggcgacgagctgtgcggccaggaggaggccttccgaggctgggcccaggctgtagttagggttaagaccaccctttggccttggtgtcaccaaggactcaaagaaggtgaaggttttggtttttttttcccccagagatggagtcttgctctgtcgcccaggctggagtgcagtggtacgatctcggcttactgcaacctccgcctcccgggttcaagagattctcctatggcgtgaacctgggaggtggagcttgcagtgagccaagattgtcccactgcactccagcctgggcgacagagccagactctgtctcaaaaaaaaaaaaaaaatattctcctgtctcagcctcctgagtagctgggattacaggcacccaccaccacgcccagctaatttttgtatttttagtagagacggtgtttcactatgttggccaggctggtctcgagctcctgacctcacaatcctcccacctccgcctcccaaagtcttgggattacaggtgtgagccaccgcgcccggaccgagggtgaaggattttaagagacccttccttcatgctgtgtccagaagtcttgcccgctctcgcagccaggaaccaaaagtcctggtaggactgagaacagttcctaggctgccatcagctgggcctggtgattcaaatccacccaggtggctaaactacaaataaaccgtacccatctactgaacataaactaaataccactattaaggatacttaaaataaacacacttagtgaacccattatgaactgaaagtgtctttcacccttcccacgttttctaaatcccctgagtcatctaagtattcttcaatccaaaatgaactatatttcctttggtgcaatctccagaaaccacagatccaaggagtttcagcaagtagagttgttttttgttttttgttttttttttaatttttttttgagatgggaagaacttgggtcctccttgctccacccaccctgcatggtgagaatggtggagcaggaaaggcaaaggggacctgatggagtgtctctcctgccagggctccctccttccggctgccacccgatcccagcttgccctgcatcctggtgggtccaggcactggcattgcccccttccggggattctggcaggagcggctgcatgacattgagagcaaaggtgaggctggtgactaaaggactgcctgaagggagtcacacaatctagggacagaggggtggggctggaaggcaggaaataggaaagagagggcaggaaacaaagtccacaaagctgaaaagacgctcatgagaccaaggggagggcaggtaccaaaggcaagggctgggccctgagcttctggcttcctggtgcctggtacatagtaggtgttgactggattgaggacaaaggaaaatagaattttcaaagggattagggctaagactcaaagaagaactgcccaaggtggattcttgactgtgccagagctgaccgaggtctgtccaagacctaaggatgctacaaggtgttcatattgagcatggggtgcccagggtggtctgtcaatcaaaagaagagggctgtgactgggaggagagttataagtatgggagaatatgaagtgggagcggggaaggggactgcgatgtcacacaatgcaaagggcatggaattctgagtccgaagccgcgcattctagcgcactccaccaggggccaccacctcacccgcgcttcccttccctctgtaaatcagggctgtgcagggtctctgtgaaagcattctacactctcttagagatgaaacagccaaagtaatggtggtttcagcccaaaacgctgggctgccaggctgggcgacggtggcctgtggggaggccccactagcactgtgccccggagaagagccttcccaagcgcggggttgcttgcagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaaggtgtgagaccctgagggcgcaatggtaacctgaagatagggagagaggggaggactcgcgctctccagcggggcacaccaaccacggccctcccgtggcctcccacgaccactcagccacccctgcacactctggcccacccttgtgccccggcccctctaggccccgcctcctcccgcccctgccccgcccctttggctctgccctgttgacaacgccccagggcacgcaggccccaccaggcccgctccggagaatttcaaggtccagggccagccagcagccccgggctgcccccgcgcccacccccaccagggcccgccctaaccccgccgccccgcagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggtgcggaggggcgggccgggcctgagcgtgcggggttcctgctaaggtctccgagtcgggttctgatccactgtgctcttttccgacaggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctcatgtggattacagttttttttttttgtttttttttttttgaaacggagtctccctctgccgcccgggctggagtgcagtggcgtgatctcagctcactgcaacctccaccccacaagttcaagtgattctcctgcctcagcctcccaagtagttgggattacaggtgcctgccaccgcgcccggctaggttttgtatttttagtaaagacggggtttcaccatcttggccaggctggtcttgaactcctgacctcgtgatccaaccgcctcagcctcccaaagtgctgggattacaggtgtgagctactgcacccggcgtggattacaattataaaatgacaagatttctgttttaacctgtgcagttgtgggtatgtggtggggaaaggggtcattcttttaacagagtcctacacgccacttgaccctgcactctgaaaacatggtttccagccagtctgggctgctcccccgtgcagttctcaggctcgtaatcgagaaggcaggtgcagcactcagctgccaggagtggggcctgccagaaacaagagtcacagagatgtgcaacagccatgagcaagctt

SEQ ID NO: 2848 - DNA, 3690 bp; single-stranded, linear
cagagtggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcattctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcc

SEQ ID NO: 2849 - DNA, 30417 bp; single-stranded, linear
gggcccagagaaagagctgtccccggggccttggggacagggtgacagccacccagagatcatggagaaggggacgtaaggaagacctcacagaggagtcatcctgcgactgtgttggttgggtccttcaggaagcagagtcccaggagttggaagcataagaggaatactgcgggcaatgcctgagaaagataacagggaccgggagcaggagtgagttgggcaggggaaggatcaggcccacaatgccaggctcacacctgcagaggagggaagaagaagaagggcctcacatcagcccagcgggggatgttacgcccacagacgccccggggctcagttactgtctaagtgttagaaataaattttcggtgccacaaaagaaatagcactcagattaaatgttcccagcaaggcaattttacttctatagaagggtgcatctcacagatggagcaatggcaagagcacacctgaacaagggaagggaaggggtttttatccctaaggcaggtagcccctacagctgtgttgttcccctattggctagggttggaccacaccgtctgagctaattgttactggctattttaaagagagcaggggtaagagccggattggcagggtaagtagtttggcaggaaggacggtcacagaacaggtgactcaggatgactcaggtcagagcaggtgaccagtggtgactcagttcggagcaggtgatagaagctaggagggggttgtttactgaaactaggggcaaggagacgaagagaacatgaaagttaaactttaagatgaagaacaaagctgaacatactgatgcattggatctttggagaggatctcagaactcattgtacttaatttacaggctaaaaccttagaagaggaatttattatatcctacacaagactccagggaagcacatggccttggactgaaggctggcatctggaagctgtcagccaccagcaccttctgcagcaggtacctgctctctaagagggaggcctgggtggtgcacctccagagctgcccaggctgggcctcaaggaagaaaaagattttcatttgtcagaggcggaagggagaggtggagggaacagcacagcagcggcccaggggcagggaagcacaggaccattagggagacacgagaaagcccatttgtctagaacagaggattcaagcagtgcaccaaggaaaatgagggccaggccaatgtgctggagtggctttgttcttggctgagggttttgggtagtgccaaagcgtaaggtaagccctgctttccagaagaatctagcagagtgtggagcccagatgggactggaaggcctgggaggggtcaggtggccacagggacgggccacagccagtggtgcaggcaagaagacaatggccatccatggtggctcacacctggaatcccagcccattgggaggtcgaggcaggtggatcacctgaggtcaggagttcgagaccagcctggtcaacatggtgaaaccctgtctctaataaaattataaaaattagccgggcgtggtggtgggtacctgtaatctcagctactcaggaggctgggtcaggagaatcgcttgaacccaggaggcggaggttacagtgagctgagatagcaccattgcattccagcctggacaacaaaagcgagactctgtctcaaaaaaaaaaaaaaattagccaggcgtggtggtgggtgcctgtcgtcctcgggaggctgaggcatgagaatcactccgggaggcagaggttgcaatgaaccaagatcacaccactgcactccagcctgggtgacagagcaagactctgtctaaaaaaaaaaaaaagacagaaggatgtcagcatctgatgctgcctgtcaccttgaccctgaggatgccagtcacagctccattaactgggacctaggaaaatgagtcatccttggtcatgcacatttcaaatggtggcttaatatggaagccacacttgggatctgttgtctcctccagcatggtagaagatgcctgaaaagtaggggctggatcccatcccctgcctcactgggaaggcgaggtggtggggtggggtggggcctcaggcttggggtcatgggacaaagcccaggctgaatgccgcccttccatctccctcctcctgagacaggggcagcagggcacactagtgtccaggagcagcttatgaggccccttcaccctccgatcctccaaaactggcagaccccaccttcttcggtgtgaccccagagctctgagcacagcccgttccttccgcctgccggccccccacccaggcccaccccaaccttatcctccactgcttttcagaggagtctggccaacacaaatcctcttgtttgtttgtctgtctgtctgctgctcctagtctctgcctctcccagtctctcagcttccgtttctttcttaaactttctctcagtctctgaggtctcgaaatcacgaggcttcgacccctgtggaccagatgcccagctagtggcctttctccagcccctcagatggcacagaactacaaaccccagcatgcactctggcctgaagtgcctggagagtgctggtgtaccccacctgcattctgggaactgtagtttccctagtcccccatgctcccaccagggcatcaagctcttccctggccggctgaccctgcctcagccctagtctctctgctgacctgcggccccgggaagcgtgcgtcactgaatgacagggtgggggtggaggcactggaaggcagcttcctgctcttttgtgtcccccacttgagtcatgggggtgtgggggttccaggaaattggggctgggaggggaagggataccctaatgtcagactcaaggacaaaaagtcactacatccttgctgggcctctatccccaagaacccaaaaggactcaagggtggggatccaggagttcttgtatgtatggggggaggtgaaggagagaacctgcatgaccctagaggtccctgtggtcactgagagtgtgggctgccatcccctgctacagaaacggtgctcaccttctgcccaaccctccagggaaaggcacacaggggtgaggccgaaccttccgtctggtgccacatcacagaaggacctttatgaccccctggtggctctaccctgccactccccaatgccccagcccccatgctgcagccccagggctctgctggacacctgggctcccacttatcagcctcagtcctcacagcggaacccaggcgtccggccccccacccttcaggccagcgggcgtggagctgaggctttagagcctcccagccgggcttgttcctgtcccattgtgtatgggataggggcggggcgagggccagcactggagagccccctcccactgccccctcctctcggtcccctccctcttcctaaggaaaaggccagggctctgctggagcaggcagcagagtggacgcacagtaacatgggcaacttgaagagcgtggcccaggagcctgggccaccctgcggcctggggctggggctgggccttgggctgtgcggcaagcagggcccggatcccatgccctgcctcactgggaaggcgaggtggtggggtggggtggggcctcaggcttggggtcatgggacaaagcccaggctgaatgccgcccttccatctccctcctcctgagacaggggcagcagggcacactagtgtgcaggagcagcttatgaggccccttcaccctccatcctccaaaactggcagaccccaccttcttggtgtgaccccagagctctgagcacagcccgttccttccgcctgccggccccccacccaggcccaccccaaccttatcctccactgcttttcagaggagtctggccaacacaaatcctcttgtttgtttgtctgtctgtctgctgctcctagtctctgcctctcccagtctctgagcttccgtttctttcttaaactttctctcagtctctgaggtctcgaaatcacgaggcttcgacccctgtggaccagatgcccagctagtggcctttctccagcccctcagatgacacagaactacaaaccccagcatgcactctggcctgaagtgcctggagagtgctggtgtaccccacctgcattctgggaactgtagtttccctagtcccccatgctcccaccagggcatcaagctcttccctggctggctgaccctgcctcagccctagtctctctgctgactgcggccccgggaagcgtgcgtcactgaatgacagggtgggggtggaggcactggaaggcagcttcctgctcttttgtgtcccccacttgagtcatgggggtgtgggggttccaggaaattggggctgggaggggaagggataccctaatgtcagactcaaggacaaaaagtcactacatccttgctgggcctctatccccaagaacccaaaaggactcaagggtggggatccaggagttcttgtatgtatggggggaggtgaaggagagaacctgcatgaccctagaggtccctgtggtcactgagagtgtgggctgccatcccctgctacagaaacggtgctcaccttctgcccaaccctccagggaaaggcacacaggggtgagccgaaggcccttccgtctggtgccacatcacagaaggacctttatgaccccctggtggctctaccctgccactccccaatgccccagcccccatgctgcagccccagggctctgctggacacctgggctcccacttatcagcctcagtcctcacagcggaacccaggcgtccggccccccacccttcaggccagcgggcgtggagctgaggctttagagcctcccagccgggcttgttcctgtcccattgtgtatgggataggggcggggcgagggccagcactggagagccccctcccactgccccctcctctcggtcccctccctcttcctaaggaaaaggccagggctctgctggagcaggcagcagagtggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacaggtaagggccaggcagctaggagcaggtgggcaacaagggtggtgtcaaggcctgaagcctggggctgggaaggtctggaacttgtagctgagtcgggagggccaggtcacaaatgcaaaagggctattaatgtgcatagaacaggacagtctgggaggctcagaaaggagaccaggatcagagtcggcaggtgaagctgggagtaagggtgccagctatagaatctggccagggtttgaatgctgctctgccgccaggagctgtttgactttgagcaagttacttaatctctctgaacctccatttatataaaacgagatatggcaatacttactccatggggaagtaagtttctagctcacagcaagccttcaacagcagcgatgattatttagctggagaagaaaggagctgacagcagtggttacaggagtgagaaagtggggtctcccagaagagggagagagttgggcaggaaactcgggcccttggggtaagcaggctgagaagacagagccaccaggcttttttcccctgctccagccccctctcctcgtggctgtcacccgaaaactggaccatgcagttcccacaagagtcctcccgggggtagaggtcccaggagggaggaaagacccggaggcctggtggggtgccaggccgggggcaggctggggctgcaggcagctatgcagggaaggctgagggccggggccctgctgctcaggcgcacccttggcctgagtccctcccttcctccctgccgctggtggctctgggaggaagtgataaggcctgcgaggcttcccttcacacatggggctgctgtcaggaggggttgtgagtgcggagggaaatcagagctgaggaatccctgcagggcttccctccactcaagcaccaggctctgtccccctcagggtagggcttatagcagctttgcggggggtggacaccccatctccagaagaggtgaggtgggcgctgcaggtgggatgcgaacttagcctcgggtcaggggctcaggagctcagcaccagcagcccctgcagcccaggaccctggtctataaacggaggcacagctcgcctctagctcctaaggcatggggaacgccagaaggcatgcggcaggtgggctgtgagatcgccagtgctgtaacaggggcctccgggtgacatctgggaaggctgaaaggaaacaaacccttcctgatgaccctatccctggctcccaacagccccccgagctccccgctaacccagcccccagaggggcccaagttccctcgtgtgaagaactgggaggtggggagcatcacctatgacaccctcagcgcccaggcgcagcaggtaaggccggcatgccctgtccccatcgtctccagggaaagggtgggtaaggcctggcctcagatggggccggagagggaagctcaacccttctttgaattggtcccttgtttccaaaaagaggagaggactgggaagaaccagaggagttgagggacatgcacgggacttgggtgaccctcagcctccagccttacccccaaccctggctcaaacttttcccccatcccacccctgcaccccttttccccctcccacccctgcacccttcctccctctcccccaccccacccctgccccccctcccatcccagctctaaacccctcctccctctcccccgtcccacccctaaaccccacctccctgtccccctctaaacccctcctccctgtccccctctaaaccccacctccctctccccatcccacccctgcacccttcctccctctgcccccgtcccacgcctgtactcctcctccctctcccccgtcacacccctgcacccctcctccctctccccatcccatccctgcacccctcctccctctgcccccgtcccacccctaaacccctcctccctctgccccaccccacccttgcacccctcctccctcttcccccgtcccctgcctgcattcctcctccctctccccatctcacccctgcacccctcttccctctcccacccctgcacccctcctccctctccccgtcccaccctgcactcccgccctctccagcgtcccacccctacacccctcctccctctgccccattccacccctgcaccccctcctccctctgccccgacccacccctgcacccctcctccctctcccccgtcccacccctgcatccctcctccctctgccccgtcccacccctacacccctcctccctctcccccatcccacccctaaacccctcctccctctcccctgtcccatccctgcacccttcctccctctccccgtcccatccctgcacccttcctccctctccccgtcccatccctgcacccctcctccctctgctcccatcccacccctgcacccctcctccctctgcccctaccccacctctgcacccctcctccttctccccatcccacccctgcacccctcctccctctgcccctaccccacccctgcacccctcctccttctccccatcccacctctgcacccctcctccctctcccctctcccacccctgtacccttcctccttctccccgtcccacccctgcacttctcctccctctaacccatcccacccctgcacccttcttccctctcccccatcccaccactgcacccctcctccctctccccctgttccacccctgcacccctcctccctgcccccaactcccatcccacccctgcaccctggcctgtcctgacctttgcactccctcgacccaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggtgacagcttcccggacgccacagcctcccttgtcccactgaggccccagaaaccccgtgacgaccttcccatgaccccctcccttcccagatcctaacaccacgtgggcccctcccgccctcccccagcacttgcacaaagcctggaggagggcctccctgtcccacacaacttcctgcttgtccccttcccacccctctcctccccaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgcggctggccagcgactgagagacccgggcgctaccaaaaggggagcggggtggcggggcagttcctaaggcttcccgggggctgggaggtcccaaactgtgggggagatccttgccttttcccttagagactggaaaggtagggggactgccccaccctcagcacccaggggaacctcagcccagtagtgaagacctggttatcaggccctatggtagtgccttggctggaggaggggaaagaagtctagacctgctgcaggggtgaggaagtctagacctgctgcaggggtgaggaagtctagacctgctgcaggggtgaggaagtctagacctgctgcgggggtgaggaagtctagacctgctgcgggggtgaggacagctgagcggagttccctgggcggtgctgtcagtagcaggagcagcctcctggaaaagccctggctgctgcttctcccccaagagagaaggcttctcccgccaggccagtccagtgcagcccctcacccacacccactgctaccccagttcccctgcttcggcccgcaccctccctcacaccccagcccacagactcggggctggccttagttactggaacgcctgtgaccacagcactaagagaagcaagctgccccatgggggacttggtccccatggccttggcctccttcaccatcactggccgccaaagagtttgaaataaagccacgtgcccagtgaatcccaaaggaacctcaactaaaataaaaacaatcctatctgacacttgcctgaccctctaagtcattcaaagctttagctcaacttcgatccatctgagctgccatagtggaccccactcagagctgcgtccctcccttgaccccaggttggtccctgccactcccctgcccctgtcactgacacatgtttcctcctccctcaggcaggagtgggacctcccagcctcctcctggggcctccactcagaatgtcaggatgagcagggtcctaggaggcctctggtgcagccttcccttcccaccatccatgtgctcaaagagaatcacccgtcctttcttgaatgccatggatcatgggggatttgctgcccacactcctaggcggcctcttagacatccgttggtgcctaacccaagcatcagtttggcagaggccgagtccctcctctgtactggataccaagtcagcttccatagggatggggagacacctggcccagggaggagatgagaagcagcccggatggtgctacatatgtcagagagcagggcaggaagggatcagtgtggctgccaatggtcaggagggcgccatggagtgaaccatggcccctgcctcctcaaccaagaagtcctctggagctgatactcaagaccccccgtctctctcctcaccctcctctcccgctgcctcggctggctcaggtgttcgatgcccgggactgcaggtctgcacaggaaatgttcacctacatctgcaaccacatcaagtatgccaccaaccggggcaaccttcggtgagtgccccccaccatgccaggccccagccttcttccccaaggcagggaaggcggggctctgaccagctctttccccatgcgtgccagctcggccatcacagtgttcccgcagcgctgccctggccgaggagacttccgaatctggaacagccagctggtgcgctacgcgggctaccggcagcaggacggctctgtgcggggggacccagccaacgtggagatcaccgaggtgggcaccgagggccacccatgagggtgtccccaaggtggagaatgaggaaaccagtgggagaaggctcgggggatccaggcaggaagaggggagcctcggtgagataaaggatgaaaaacaccaaaggaggggtgcctgggtggtcacggagacccagccaatgagggaccctggagatgaaggcaggagacagtggatggaggggtccctgaggagggcatgaggctcagccccagaaccccctctggcccactccccacagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgtgagcaccaaagggattgactgggtgggatggagggggccatccctgagcctctcaagaagggcctgcaagggggtgctgatcccacaccccaacacccccaggctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggtgaggtgcgggatggggctcgggcaccgaatgcacctgtccaaggcaggagtctggctctcactccatccccaaaatgccagccacggggacaatcagagcaggtccagggttgcctcctaaatgggaactgaggacaagctctagaaccactgaagcaaaggggtagggggtggcaggggtgtgtgtgggggtgtgagtgggtgagtgtgagagtgtgggtttctggggtgtgcagtgggtgagagtgtgggcttgtggggtgtgtagtgggtgtgagactgtgggtttgtaggggtgggtgagtgtgggtgtgtgggggtaggtgggtgtgggtttgtgggtgtgtataggcagtgactgtgagactgtgggtttgtgggggtaggtgactgtgggtttgtggggtgtgtaggggtgagtgtgtgtgggtttgtaggggtaggcgagtgtgggtttgtggggtgtgtaggggtgagtgtgtgtgagtttgtaggggtaggcgagtgtgggtttgtggggtgtgtaggggtgagtgtgtgtgagtttgtaggggtaggtgagtgtgggtttgtggggtgtgtagggggtgtgtgtgggcttgtaggggtaggcgagtgtgggtttgtggggtgtgtaggggcgagtgtgagagtgtaggtatgtgggtgtgagtgtggatgtgtgtaggcggtgagtgtgaaattgtgggtttgtgggggtgggtgggtgtgagtgtgtgggtttgtgggtgggtgtgggtgtgagtgggtgggtgaggggggcatggggatgggtgtgaacatgtagttgttctttcaggcataggacccatagctctagagctttcatcagattctcaaaggggaccttgactcggaaaaggttaagacccattttagagatgagaaattaaagcctggagctgaggagcgactggcccaaagtccctctctgctctgaggtgcttcgcaggcaaaaacctgaaccagccccctaggcagccaggcctcccaatggacaccactcacctcactccttccagccatgtacgggaaacagagatagtctccccaccccacccccgtgatcacctctgtccctaccgatgccacacacccttctgccccaggatgtggctgtctgcatggacctggatacccggaccacctcgtccctgtggaaagacaaggcagcagtggaaatcaacgtggccgtgctgcacagttaccaggtgcagaggcccagactggccaggaaggcaaagggtttgcatacgggggcagcaggggcgggggatggaggagaggcagccatttagaaactagggcaggatttggacaggcagaagaagttccgtagtcccagtgccatggcgcacactggctgcggttcggggacagggcaggtactattccaggcgctgtcatctggtggcttactgtgtgccagggaccttgctgtttactgcatgcccagtcatgctgattctcagggcatattgggtattgcagtttgtgggacccgctggatcctggaaacaaataccaggatcaagggcacaccaggagtcgtagtttgaggaagccggggcctgctgagaatttctgtgggctatttggtttggggaccaggcatgcagatgctggagattagagctgcttgttgcatgttgaacctgcagcatgaccatgcatgatgtggtttggggtgagggtgacattgtggtttgaggggacacagggtgtgttagatatggggtaatcgagggcacatgtggtttggggtgaccggagtggtggaggaagaatgggcgaggtctgtgggtctggtttgagcctctccccctctctctcccttccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccaggtgcccaccctaatggctctgccagcctgggcccagctctaattctaagcagcccctggggacctctaacctttccttttctttacctcccctcccaaccccatcatctctctgcagccagacccctggaaggggagtgccgccaagggcaccggcatcaccaggaagaagacctttaaagaagtggccaagtgggtcccctgggagccccgctctcccacacacaccctgggggccccactctcccccacacaccctgggggaccctgccccagcagtgttctggacctaccactcagtatcccaaaaccctgttgtgagggggttggacccttgcctggggaggccctgcctctgtgcacccgggacaccctcacaccttcctctcccgcagcgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtagggctgagcccaggggagcagggagctagaaagagggggctctatcagcatcttcaggggtgccctggaggacaggaagtgttacaagtcaggactcatgaggaacccggaaccacaggtgttcagagatcaagttggggcctgaatcttgcactgccagggaggccagagtgaggagggcagggcctccgggggccacagcacccaggacatctgtcttcccacccacaggtcctgtgtatggatgagtatgacgtggtgtccctcgaacacgagacgctggtgctggtggtaaccagcacatttgggaatggggatcccccggagaatggagaggtgagaacttccaggaaaggggctgctgggaatgaggagagactcagaattggagtgactgggcaggaacctctgcccaacacacacacacacacacacacacacacacacacacacacacacacacacacacacacacacacacacacacgccaggatggaaagggagatgctaagagacccctggagcctgaaaccccacacaacgtacgctcccagcccacccatgtggctgcctccctgcaagcacatttgcttaactgcgcgtccccaagtcatttccattatcagtgcaagtttttaatacaaggaaggcacatcctggctgaccaagaggttagactgtgctcgggcactgacaagaaaaacagggatacgtcactgagggcggcttctaggatgcgggtaatgtttcttaatgggatactggttacacaggtgtgttcagtttgtaaaaatccacagagctgtacatttacaacatgtacaacactattccagcattttattttatttgttttatttattttgataacctatttacgttgcccaggctggccttgaactcctagcctcaagagatcctcctgccgcaggctcctttttcaaaagaagaaattgagcgctgtttagatgccaacatagattaaataacttcactttttaaaaagaaacacaaagctagagtaccatcattgaattccttctcttgcaagcttaggtatctctgaggtgccccaggctaggctcatttctgagtcttacctgctccagcttctaggtgttaaaggccttattagcactaagtacttcctcagtactcttttttcttttttcctttgagacagggtctcactttgtggcccaggctggagtgcagtagtacaatcacggctcactgcagcctcaacctcctagactcaagcaatcctcccacttcaacctcccaagtagttgggactacaggcgcatgccatgatgcctagctaatttttgtattttttatagagatggggtttcgccatgttgcccaggctggtctctaactcctgggttcaagcaatccacctgcctcggcctcccaaagtgctgcgattatagacgtgagccactgcacctggcccgcagtatcttaagcaagttggaatctcgtgaaaccctttttgctgccttagtgtccgtttcagccctcattcttacctaccttttcaagaaaaatagcaccagcaattgacttttttttagcataaaggtgtatagaacccatataacctacagccttcacaaggcatagcacattttcaccaccctggaaagttccctcatcagttcctcacgtgaatcccttcccagtctgtctccctgccagaagtgtctgtcaccacagaatagtttcgcctgctctagaacggcacctagatggaagcacgcagtgttgcggcgtctcctgctgaggctgtttttgaggcgcactcgtgttgctgcgtgactcagtatttcactcattctgctgctgagtgccgttcattgtgtgaatatccccagtttgtttacccattctcttgttggtgacacttgggctgtttccaggtcggggctattatgaataaacctgttatgaacattctgtacccggcttttgtgggcttatgtttttatttctcttgggtaaaacctaggagtagaattggtaggtcatagggtagatgcatgtttaatctttcacttttttaaaaaataaaactgccaggccaggcgcggctgctcacgcctgtgatcccagcactttgggaggcccaggtgggtggatcacttgaggtcagaagctcaagaccagcctggccaacatggcaaaaccctgtctctactaaaaatacaaaaattagctgggcatggtggcgcacgcctatagtcctagctactcaggaggctaggcgggagaattgcttgaacctgggaggtggaggttgcagtgagccgagatcacgccactgcactccagcctgggtgacagagcaagaattctacttaaaataaaatacaaataaataaaataaaactgtcaaacagcaaagcaaattaaactgccctttaacatctgtgcagttcaatgtatgttaattttatcccaaatttttaacaaatctaggaatacagctcacagaaaatggggtatattcactaaaaataaggaatatttatagcaaatttgtttgtaataccccacactggaaacaattcaaatgaccatcgacaaatactgataaattgtggtatattcaagtgccatatcgcactaagtgtgaacgaaacacaaccacacacaacagtgcaggtgaatctgaaaaaatgtgaagagaagaaaaagccagaccaaagaatacatactgtactacagggttcactttatataaagttcagaaacaggcagaactaatccacggagttagaaattaggagaggagttagtcactgggatgggggtggcagtgacaggaagaaggcacgaagttggcttctaggatgcgggtaatgtttgtttgtttgtttgtttgtttgtttttgtttttgagctggagtctcactctgttgcccaggctggagtgcaatggcgtgatctcggctcactgcaacctccgcctccccggttcaagcgattctcctgcctcagcctcccgagtagctgggattacaggtgcccgccaccatggccagctaatttttgtgtttttagtagagacgcgtttcaccatgttggccaggctggtcttgaatccctgacctcagcctcccaaagtgctgggattacaggcgtgagccaccacgcccagccacgggtaatgtttctcgatgggatgctggttgcacaggtgtgttcagtttgtgaaaacttacagagttgtacatttacaacatgtgtgcacctctggacttgtgttgcacgttgacaaaacattcaaaaatgaaattcaaatcgttcttgctaactctggcgcacttgggaaccagcacccagaggcatctgcagttgagcaccagatgcagttccttccagcttccttccccctgggaggtccgcttgatgccacttcttcatggcagcacaaacaaggccatggtcttctgaggagggcaacctgcacaatgtctgctagtgaccaggacactgctgaaggaactgagagtttgtccacccatgaaatccactaaaacaggaaagattttgctctagccgttgttagccaggagtgaggaaagagctgtgccctcccctgcagctgcgaggacgatctgcctgccccaacaagtggggattcagcaactccacttctaaggattacccagctgaagcatttaaaagtgggagcaaggcacacgtacaagggcgtttgagagagcacctgttcccagaccaccgagctgcccttcagtctcagtgaagtacaatgtagccactaaaaagactgaggtcatgttttggaaagtccaggccggaggatcgcttgagcccaggagttcaaggccagactgaacaacacagcgagactccatctcttcagaaaatttaaaaattaaccaagagtggtggcacgcacctatagatctagctactaggaaggcagaaaaatcccttaagcccaggagtttgaggttacagtgaatgatgatggagccactgcaccccaacctgggcgacagagcaagacccatatctaaaaacaatactactacttacgtcaatattgttgtattgacctggagggatgtctgcaataaattattgattaaaaccaaggaagtacagtatggtaccacttttacttaaaaaaaaactataaatatgcacgtgcacgtaagttcaaggaaaaagggctggaaggttaacacctgtgaatggcgcatatgcccggaggaagatggggtggtctttgtcttatcactttacacatttctgtaatgtcatttttcaaaaacatcagatcgcttttgaaattttcaaaacaaataaaaattaagtgacaaatcaataataatgaggatcagctggtacagttttaaacttctatgtagtttgaaatgaaacaaaactaaccctgatgcaaacactcccctcgccagagctttgcagctgccctgatggagatgtccggcccctacaacagctcccctcggccggaacagcacaagtgagttgggtgagagtttgggggagctgggggagctgatgcatttggagacacaaacagaaagggggtctgaaaagctctccctctgtgcctcaagtcgttttcccaccaaaagccagggctccaggatgccctccattccaggctgcaatggcagtccagacctgcctgcttctgagagccgggacagtcctgaggtcttcagagatgggggtgtggtgtgtcagggccccaggctcggaaccccagggatgctggccctcagcccctcccaagggcagggcctttcctgtccagaggcagagaccctgaagccgtccctggggctgggtctgggcctagcctgtatccccagggccctgtgacaaccttgtctttgtcctctcttgccaggagttataagatccgcttcaacagcatctcctgctcagacccactggtgtcctcttggcggcggaagaggaaggagtccagtaacacagacagtgcaggggccctgggcaccctcaggtcagggcctcaccaagaggggtgcaacgggtgggcaagctgcctgggcaaacgtggcctgcaaagggagctccactgacgacccctgcaccccaggttctgtgtgttcgggctcggctcccgggcatacccccacttctgcgcctttgctcgtgcggtggacacacggctggaggaactgggcggggagcggctgctgcagctgggccagggcgacgagctgtgcggccaggaggaggccttccgaggctgggcccaggctgccttccaggtgagcccagcccagcccctgctctgactcctgccccctgggatgcctcctcctgcctcactctgccctgattctgtttggttctttggtcccttcctgttccttccaaaatccaccctcatctctccatggcatagccagctcttctgggtcaggggcagaggatgacatggccctgccgaccacaggggtgcctagcccaggcagaagtgcagccgaaagagagcaggcagggccctggcaggagggagcttcagccaggcacaggctgggcctcacaagtgggcgcacaaagggagggggtgcagggcagggcaggggaccccacccaggatgggcaggatggagggagaaggaagggacagagagaaggtcagacagaggcaagggctgaagctgaggccagcacagaagccacaggaagccagaggccagacagcctggggcggtgcctgcaccagaactggtccgggccaggcaagcaagcacagggagaggtggatccctgggggctgtggctttttaagcctgggcttcctcaggggcagtgctgcctgtctggggatcatgtctgcagttgacaagggctcggtctccccagtgccacactgttcagggcagtgctgctgtcccggggcccaggctggagctcagcagatttgccttgattggaggaggagggcatcctaggaggagagggagtgggggctacctcagggacggggaggtcaggctgcagaaacacataggccctgattgggaagaagggacacggtaaaataagctctaaaagaatttaaaacaaaaagagccattgcagcgggatgagaccacatcatcaggttttgggaataggactttagaggcgtaggatccattacagcatcaccgaaccagaagcaggaaggctgagctaagcagagcagcagcagtggagataggaaggaagggagggaggggccgaggaaggaaggaagagatataagacttcacacgcaccacaaaagaaagattaacgggacttggtgatatgaggctcagccaatcacgggtgagccctgcatttcaagcctgggactggcccagcagttttccagctgtgtgcctgaccaggagtagacgggatccacaccctcccagggatctgccccgtggggtcccctctgccgcccgaattgtgcgtcccttcccaggagcacttactatctgcacgcactttgtggaaagctaagggctttacataaagtatctcatttaatcttcaccagaacacaatgaggtgtaaagatggggaaactgaggcatgtcactgtaagtacgggattcggaatttgaatgcaggtctgaacacacagacgccttcacagagctaccgtgtgccaagcactatgcttctcggatcacgggattaacacgcaccagataaggaacgatgcaccaatcaggacgtgcagagaaagagccagccgggtccctgggcccagcggccaatccatgaaatgggctggcggaaaaggtgctgtccttggcgccggcctcagccactggggctgccaaccccccaggagcaagacgcagtgaagccgcccaggcgcctcactagggcgacccctggtggcgggaggtcctcagccctcaccggcctgtcccgcaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtgggccctgcctcaccctaacccggctggttctctgaggcccccacaccccgggactaaagcactctggggccaggccctgctccctagctcaggctgcctcatttgcccctccccgcccccaggtctgatccacgtgcacaggcggaagatgttccaggctacaatccgctcagtggaaaacctgcaaagcagcaagtccacgtgaggacgacggctttaccgccccccaacccctgtcctgaacaccctgaccctggaccctcctcctcccacattctcccgcccccacccctctctgactccccataagtgcccctctccccacccccaggagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtgaggggcagcctgggaagcaacagggcacaccagccccatgcccagccccacccccggccccaggcctccaggagctcaggacccgacccagggggtggccacctcctccacagctcagcaggcaggctcagagctggctgtgctgcccactgccgggctggccttgttgctggaccatccccacaccctcaaatgcacccccaccaaaaggctgtcccctccctctgggctcctctccaaggctcccctagcaatctagcttgctctggagctggcactggggctatttgctgccacatcaatgcctgggctttatttaaaataagggggtggagtcagaggcagaggagcccagaccaacccagtccggccaggggcccccgaacaatacactgaggctacctagacaggccgaccccgctgctcaagggcaggctctctaacagtcaccaaaacacaaacatcagcccaggtactgcagtcctgctgggccctgtcctcagagctccctgtgcactatccccaggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggttgggggccaccccaatgaggcacaggggctagagagacgggatgagctggggggaccccagtggcaggaaacccccatgcaaagtcccccctggactttcttctcctggctgacatgcactggtgctttaagacccagctcctcagggaggaattcatggctggattctccaggtcttagagaaaactctattggcctgaactgagcagggagaaaccctaaagaggctcagtgggggaggggtcaagaagggaggttactaggaagggctatggggcctccaacccactgcatcctgccccgccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcagggtgaggcaacaagcaggagcaggcctggccacagcagggttgggaccggcccctctctggcccctcaccggcctctccttcccacccccagatgggctgggccccctgcactatggagtctgctccacgtggctaagccagctcaagcccggagaccctgtgccctgcttcatccgggggtaagtgagatggaggacttggtggggagctgcccagggtcagggtggcagctttggtgaggagtgtcactggtgaggggtgtcactggaaacaggaaggagctctgtaacatgtcaagggtgtggtgtcattaggtcacttcagaactctggctaagctttggctctctcattcatttagactcagagttctgccctgaaactatagctcccagagccagagctggtatcaaaccggctggccctgtggctttctgaaagcttctgtgttcctctctatgtccctgggctgtctgatgttgggcagcatggcacctgggaactacagtcactaaatcctcactcaatccagggagaactactagttagggttaagaccaccctttggccttggtgtcaccaaggactcaaagaaggtgaaggttttggtttttttttcccccagagatggagtcttgctctgtcgcccaggctggagtgcagtggtacgatctcggcttactgcaacctccgcctcccgggttcaagagattctcctatggcgtgaacctgggaggtggagcttgcagtgagccaagattgtcccactgcactccagcctgggcgacagagccagactctgtctcaaaaaaaaaaaaaaaatattctcctgtctcagcctcctgagtagctgggattacaggcacccaccaccacgcccagctaatttttgtatttttagtagagacggtgtttcactatgttggccaggctggtctcgagctcctgacctcacaatcctcccacctccgcctcccaaagtcttgggattacaggtgtgagccaccgcgcccggaccgagggtgaaggattttaagagacccttccttcatgctgtgtccagaagtcttgcccgctctcgcagccaggaaccaaaagtcctggtaggactgagaacagttcctaggctgccatcagctgggcctggtgattcaaatccacccaggtggctaaactacaaataaaccgtacccatctactgaacataaactaaataccactattaaggatacttaaaataaacacacttagtgaacccattatgaactgaaagtgtctttcacccttcccacgttttctaaatcccctgagtcatctaagtattcttcaatccaaaatgaactatatttcctttggtgcaatctccagaaaccacagatccaaggagtttcagcaagtagagttgttttttgttttttgttttttttttaatttttttttgagatgggaagaacttgggtcctccttgctccacccaccctgcatggtgagaatggtggagcaggaaaggcaaaggggacctgatggagtgtctctcctgccagggctccctccttccggctgccacccgatcccagcttgccctgcatcctggtgggtccaggcactggcattgcccccttccggggattctggcaggagcggctgcatgacattgagagcaaaggtgaggctggtgactaaaggactgcctgaagggagtcacacaatctagggacagaggggtggggctggaaggcaggaaataggaaagagagggcaggaaacaaagtccacaaagctgaaaagacgctcatgagaccaaggggagggcaggtaccaaaggcaagggctgggccctgagcttctggcttcctggtgcctggtacatagtaggtgttgactggattgaggacaaaggaaaatagaattttcaaagggattagggctaagactcaaagaagaactgcccaaggtggattcttgactgtgccagagctgaccgaggtctgtccaagacctaaggatgctacaaggtgttcatattgagcatggggtgcccagggtggtctgtcaatcaaaagaagagggctgtgactgggaggagagttataagtatgggagaatatgaagtgggagcggggaaggggactgcgatgtcacacaatgcaaagggcatggaattctgagtccgaagccgcgcattctagcgcactccaccaggggccaccacctcacccgcgcttcccttccctctgtaaatcagggctgtgcagggtctctgtgaaagcattctacactctcttagagatgaaacagccaaagtaatggtggtttcagcccaaaacgctgggctgccaggctgggcgacggtggcctgtggggaggccccactagcactgtgccccggagaagagccttcccaagcgcggggttgcttgcagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaaggtgtgagaccctgagggcgcaatggtaacctgaagatagggagagaggggaggactcgcgctctccagcggggcacaccaaccacggccctcccgtggcctcccacgaccactcagccacccctgcacactctggcccacccttgtgccccggcccctctaggccccgcctcctcccgcccctgccccgcccctttggctctgccctgttgacaacgccccagggcacgcaggccccaccaggcccgctccggagaatttcaaggtccagggccagccagcagccccgggctgcccccgcgcccacccccaccagggcccgccctaaccccgccgccccgcagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggtgcggaggggcgggccgggcctgagcgtgcggggttcctgctaaggtctccgagtcgggttctgatccactgtgctcttttccgacaggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtcgaatgttagattcctcttgcctctctcaggagtatcttacctgtaaagtctaatctctaaatcaagtatttattattgaagatttaccataagggactgtgccagatgttaggagaactactaaagtgcctaccccagctcatgtggattacagttttttttttttgtttttttttttttgaaacggagtctccctctgccgcccgggctggagtgcagtggcgtgatctcagctcactgcaacctccaccccacaagttcaagtgattctcctgcctcagcctcccaagtagttgggattacaggtgcctgccaccgcgcccggctaggttttgtatttttagtaaagacggggtttcaccatcttggccaggctggtcttgaactcctgacctcgtgatccaaccgcctcagcctcccaaagtgctgggattacaggtgtgagctactgcacccggcgtggattacaattataaaatgacaagatttctgttttaacctgtgcagttgtgggtatgtggtggggaaaggggtcattcttttaacagagtcctacacgccacttgaccctgcactctgaaaacatggtttccagccagtctgggctgctcccccgtgcagttctcaggctcgtaatcgagaaggcaggtgcagcactcagctgccaggagtggggcctgccagaaacaagagtcacagagatgtgcaacagccatgagcaagcttcagagtggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcattctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcc

SEQ ID NO: 2850 - DNA, 1872 bp; single-stranded, linear
aggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggaccggccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctc

SEQ ID NO: 2851 - DNA, 4286 bp; single-stranded, linear
gagacattccggtgggggactctggccagcccgagcaacgtggatcctgagagcactcccaggtaggcatttgccccggtgggacgccttgccagagcagtgtgtggcaggcccccgtggaggatcaacacagtggctgaacactgggaaggaactggtacttggagtctggacatctgaaacttggctctgaaactgcgcagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttttttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccctttccttctccatgtcagtatcatgttctctaattatcttgccaaattttgaaactacacacaaaaagcatacttgcattatttataataaaattgcattcagtggctttttaaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctggg

SEQ ID NO: 2852 - DNA, 1719 bp; single-stranded, linear
gggctgcaggtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgaccccaaagtgtctgtcttccttcctctgcttgtctctaggctctgaaactgcggcggccaccggacgcttctggagcaggtagcagcatgcagccgcctccaagtctgtgcggacgcgccctggttgcgctggttcttgcctgcggcctgtcgcggatctggggagaggagagaggcttcccgcccgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaaaaaaaaaaaaaaaaaaa

SEQ ID NO: 2853 - DNA, 4156 bp; single-stranded, linear
cccactatgttggccaggatggtcttgatttcttgacctcgtgttctgcccgcctctacctcccaaagtgccgggattacaggcgtgactgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttggctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcactttttggacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatgggggggtgattgaggaacaagatgtctctaagatgagaagttattttcttgcatcatagaagcactctythyacccgngagtgattgtgttaactataaatcatttatatctgtacattaaagcagattccctcaattaggcaaatttggttagccaagcccaagttattgtttgtacttgaaagtaataaagctgcatttccttaaaaatatattctgtagttaagactttgtcttgctttccggaattcctgtttttcttttcctctagagacctcggcttgcaactggatcaaacgctgtcgaaaggatgtaaataggcagagcaactgttaccaagaaggccaccacccccacccaaaggcagtgaggagtgtggggcttcgtctgggctcccccgagtctcaacagtaatcaacagtcaggtgttgattgcaacttttcaaggtcagccaccgggagtagcctattccctctaggaaccttggagggcataccttgctgggactcaacttggctgagaaatgcacaagatgccaaaggaggaaggattatagggggcgtgtgtgtgacccccaagaccgatcttccgctatcaccctaatctccggttccccgctacccgggcgggggtgagtatgtgacatgtgcctaactctcagcagcaacttcggcagcaggtgtcgatcctaactaagcaggagctgcggctgccgggtgtgccctcaccaagccatgcgagccccgggcgcgcttctcgcccgcatgtcgcggctactgcttctgctactgctcaaggtgtctgcctcttctgccctcggggtcgcccctgcgtccagaaacgaaacttgtctgggggagagctgtgcacctacagtgatccagcgccgcggcagggacgcctggggaccgggaaattctgcaagagacgttctgcgagcccgagcacccagggaggagcagggggcagcgtttcttgcgggaccctcctgggacctgccggcggccccggaccgtgacccggctgcaggcagaggggcggaggcgtcgacagccggacccccgggacctccaaccaggccacctgtcccctggaggtggaaaggtgctcggggtcaggagccttctgaaactttggggagagggaaccccacggccctccagctcttccttcagatctcagaggaggaagagaagggtcccagaggcgctgtcatttccgggcgtagccaggagcagagtgtgaagacagtccccggagccagcgatcttttttactgtccaaggagagccgggaaactccagggttcccaccacaagcccctgtccaagacggccaatggactggcggggcacgaagggtggacaattgcactcccgggccgggcgctggcccagaatggatccttgggtgaaggaatccatgatcctgggggtccccgccggggaaacagcacgaaccggcgtgtgagactgaagaaccccttctacccgctgacccaggagtcctatggagcctacgcggtcatgtgtctgtccgtggtgatcttcgggaccggcatcattggcaacctggcggtgatgtgcatcgtgtgccacaactactacatgcggagcatctccaactccctcttggccaacctggtcttctgggactttctcatcatcttcttctgccttccgctggtcatcttccacgagctgaccaagaagtggctggtggaggacttctcctgcaagatcgtgccctatatagaggtcgcttctctgggagtcaccactttcaccttatgtgctctgtgcatagaccgcttccgtgctgccaccaacgtacagatgtactacgaaatgatcgaaaactgttcctcaacaactgccaaacttgctgttatatgggtgggagctctattgttagcacttccagaagttgttctccgccagctgagcaaggaggatttggggtttagtggccgagctccggcagaaaggtgcattattaagatctctcctgatttaccagacaccatctatgttctagccctcacctacgacagtgcgagactgtggtggtattttggctgttacttttgtttgcccacgcttttcaccatcacctgctctctagtgactgcgaggaaaatccgcaaagcagagaaagcctgtacccgagggaataaacggcagattcaactagagagtcagatgaactgtacagtagtggcactgaccattttatatggattgggcattattcctgaaaatatctgcaacattgttactgcctacatggctacaggggtttcacagcagacaatggacctccttaatatcatcagccagttccttttgttctttaagtcctgtgtcaccccagtcctccttttctgtctctgcaaacccttcagtcgggccttcatggagtgctgctgctgttgctgtgaggaatgcattcagaagtcttcaacggtgaccagtgatgacaatgacaacgagtacaccacggaactcgaactctcgcctttcagtgccatacgccgtgaaatgtccacttttgcttctgtcggaactcattgctgaaggacagtacttggttgggtcagatttatttgtttgattttcatatcccgtgaaagtttttaattcatatttttccttatagggaaaaatgcaaaaaagaaacaataaagaaagaaatattaactactgtagaactgattttacaaattaatatttgtgctttgaaaaaaagtttctatttagttatttaagaagaatgagaaggccaatagttttagattattttatctggtatggtgctaatattttatttgaaaaaagttactgcaacttaacttaaaattgctaacgttttttcttcttttaaaaatacaattattgtatattaattatagcaatgtgattttgtaggttattttatatttgagttgtgattgaaagtatgttgtatatggtattgtgagatgatttgtacttggaagcattcacaaagtagcaccaaataaattacactttattctttaatgtcattgtcaatctacttttaaccaatattcaataaatcttctaattgccttaaaaaaaaaaaaaaaaaa

SEQ ID NO: 2854 - DNA, 1578 bp; single-stranded, linear
gggctgcaggtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgaccccaaagtgtctgtcttccttcctctgcttgtctctaggctctgaaactgcggcggccaccggacgcttctggagcaggtagcagcatgcagccgcctccaagtctgtgcggacgcgccctggttgcgctggttcttgcctgcggcctgtcgcggatctggggagaggagagaggcttcccgcccgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaaggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcac

SEQ ID NO: 2855 - DNA, 13611 bp; single-stranded, linear
aggagtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgacccaagtgtcctgtcttccttcctctgcttgtctctaggctctgaaactgcggagcggccaccggacgccttctggagcaggtagcagcatgcagccgcctccaagtctgtgcggaccggccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctattcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcgagacattccggtgggggactctggccagcccgagcaacgtggatcctgagagcactcccaggtaggcatttgccccggtgggacgccttgccagagcagtgtgtggcaggcccccgtggaggatcaacacagtggctgaacactgggaaggaactggtacttggagtctggacatctgaaacttggctctgaaactgcgcagcggccaccggacgccttctggagcaggtagcagcatgcagccgcctccaagtctgtgcggacgcgccctggttgcgctggttcttgcctgcggcctgtcgcggatctggggagaggagagaggcttcccgcctgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaacactcacagctacatatgacattttatgagctgtttacggcatggaaagaaaatcagtgggaattaagaaagcctcgtcgtgaaagcacttaattttttacagttagcacttcaacatagctcttaacaacttccaggatattcacacaacacttaggcttaaaaatgagctcactcagaatttctattctttctaaaaagagatttatttttaaatcaatgggactctgatataaaggaagaataagtcactgtaaaacagaacttttaaatgaagcttaaattactcaatttaaaattttaaaatcctttaaaacaacttttcaattaatattatcacactattatcagattgtaattagatgcaaatgagagagcagtttagttgttgcatttttcggacactggaaacatttaaatgatcaggagggagtaacagaaagagcaaggctgtttttgaaaatcattacactttcactagaagcccaaacctcagcattctgcaatatgtaaccaacatgtcacaaacaagcagcatgtaacagactggcacatgtgccagctgaatttaaaatataatacttttaaaaagaaaattattacatcctttacattcagttaagatcaaacctcacaaagagaaatagaatgtttgaaaggctatcccaaaagacttttttgaatctgtcattcacataccctgtgaagacaatactatctacaattttttcaggattattaaaatcttcttttttcactatcgtagcttaaactctgtttggttttgtcatctgtaaatacttacctacatacactgcatgtagatgattaaatgagggcaggccctgtgctcatagctttacgatggagagatgccagtgacctcataataaagactgtgaactgcctggtgcagtgtccacatgacaaaggggcaggtagcaccctctctcacccatgctgtggttaaaatggtttctagcatatgtataatgctatagttaaaatactatttttcaaaatcatacagattagtacatttaacagctacctgtaaagcttattactaatttttgtattatttttgtaaatagccaatagaaaagtttgcttgacatggtgcttttctttcatctagaggcaaaactgctttttgagaccgtaagaacctcttagctttgtgcgttcctgcctaatttttatatcttctaagcaaagtgccttaggatagcttgggatgagatgtgtgtgaaagtatgtacaagagaaaacggaagagagaggaaatgaggtggggttggaggaaacccatggggacagattcccattcttagcctaacgttcgtcattgcctcgtcacatcaatgcaaaaggtcctgattttgttccagcaaaacacagtgcaatgttctcagagtgactttcgaaataaattgggcccaagagctttaactcggtcttaaaatatgcccaaatttttactttgtttttcttttaataggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcacccacaaacttgttctttaatttcatcccaatcactttttcagaggcctgttatcatagaagtcattttagactctcaattttaaattaattttgaatcactaatattttcacagtttattaatatatttaatttctatttaaattttagattatttttattaccatgtactgaatttttacatcctgataccctttccttctccatgtcagtatcatgttctctaattatcttgccaaattttgaaactacacacaaaaagcatacttgcattatttataataaaattgcattcagtggctttttaaaaaaaatgtttgattcaaaactttaacatactgataagtaagaaacaattataatttctttacatactcaaaaccaagatagaaaaaggtgctatcgttcaacttcaaaacatgtttcctagtattaaggactttaatatagcaacagacaaaattattgttaacatggatgttacagctcaaaagatttataaaagattttaacctattttctcccttattatccactgctaatgtggatgtatgttcaaacaccttttagtattgatagcttacatatggccaaaggaatacagtttatagcaaaacatgggtatgctgtagctaactttataaaagtgtaatataacaatgtaaaaaattatatatctgggaggattttttggttgcctaaagtggctatagttactgattttttattatgtaagcaaaaccaataaaaatttaagtttttttaacaactaccttatttttcactgtacagacactaattcattaaatactaattgattgtttaaaagaaatataaatgtgacaagtggacattatttatgttaaatatacaattatcaagcaagtatgaagttattcaattaaaatgccacatttctggtctctggggggctgcaggtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgaccccaaagtgtctgtcttccttcctctgcttgtctctaggctctgaaactgcggcggccaccggacgcttctggagcaggtagcagcatgcagccgcctccaagtctgtgcggacgcgccctggttgcgctggttcttgcctgcggcctgtcgcggatctggggagaggagagaggcttcccgcccgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaagtcatgcttatgctgctggtgccagtcatttgaagaaaaacagtccttggaggaaaagcagtcgtgcttaaagttcaaagctaatgatcacggatatgacaacttccgttccagtaataaatacagctcatcttgaaagaagaactattcactgtatttcattttctttatattggaccgaagtcattaaaacaaaatgaaacatttgccaaaacaaaacaaaaaactatgtatttgcacagcacactattaaaatattaagtgtaattattttaaaaaaaaaaaaaaaaaaacccactatgttggccaggatggtcttgatttcttgacctcgtgttctgcccgcctctacctcccaaagtgccgggattacaggcgtgactgctgtgcccggccccagcatcacttttatagctttctgtgcctcttcctctgggccttggtgtatgaagccacttgcctttctctgttgggaagcgagcagaatcagattgctactcatgatgcagtccgggcagggcatactgtcacctttggctgtggacacagttgtcaggataggggagaagccctttaggtccgtcttcttgacacagccctcctacctggttacgctggtgctttcgcttggtttagacaaccaagacacttgagaattatgctgtcctcagaatgtctgatgaaaagaacagattcactttttggacacaatgcccattagccatctttggcagtgtttctgatcaaaggttccccatgcctgctctaggaaagtaaacttttttcagaataaatcctcaaatggattactgagtagtctttgcaccattcccatcagcctaatcagactgaatggtcacgctcagtgcaaaaagctgttttgctgttaggatgtttcagtgtttcttgtctttcctggaacagttcagttgtttaaatttagtaattcaatcctgaccagtgtaaacccacttaattattgcagcctaaagaattcagctacttctactcttcataaatgtgcccaagtaaatatgtgtttttaatattcaaccctggaaaattagtaattcagatgataaaagctcatgttttggtgtctttgtactcagattgtgaacaggcatatttcactgatttagacttagtatacttgatgagaatgctcaggttgaagagatagttctgtcagcaatccaacatctatagcaatgtggaaaaagtaatcaactcatatttcacgaatttgatgtatgttgtgatttagagggcatgagataaagtttatatttgaactgtgtggggtagggggaagaagaggttgcttaagcaaatgggggggtgattgaggaacaagatgtctctaagatgagaagttattttcttgcatcatagaagcactctythyacccgngagtgattgtgttaactataaatcatttatatctgtacattaaagcagattccctcaattaggcaaatttggttagccaagcccaagttattgtttgtacttgaaagtaataaagctgcatttccttaaaaatatattctgtagttaagactttgtcttgctttccggaattcctgtttttcttttcctctagagacctcggcttgcaactggatcaaacgctgtcgaaaggatgtaaataggcagagcaactgttaccaagaaggccaccacccccacccaaaggcagtgaggagtgtggggcttcgtctgggctcccccgagtctcaacagtaatcaacagtcaggtgttgattgcaacttttcaaggtcagccaccgggagtagcctattccctctaggaaccttggagggcataccttgctgggactcaacttggctgagaaatgcacaagatgccaaaggaggaaggattatagggggcgtgtgtgtgacccccaagaccgatcttccgctatcaccctaatctccggttccccgctacccgggcgggggtgagtatgtgacatgtgcctaactctcagcagcaacttcggcagcaggtgtcgatcctaactaagcaggagctgcggctgccgggtgtgccctcaccaagccatgcgagccccgggcgcgcttctcgcccgcatgtcgcggctactgcttctgctactgctcaaggtgtctgcctcttctgccctcggggtcgcccctgcgtccagaaacgaaacttgtctgggggagagctgtgcacctacagtgatccagcgccgcggcagggacgcctggggaccgggaaattctgcaagagacgttctgcgagcccgagcacccagggaggagcagggggcagcgtttcttgcgggaccctcctgggacctgccggcggccccggaccgtgacccggctgcaggcagaggggcggaggcgtcgacagccggacccccgggacctccaaccaggccacctgtcccctggaggtggaaaggtgctcggggtcaggagccttctgaaactttggggagagggaaccccacggccctccagctcttccttcagatctcagaggaggaagagaagggtcccagaggcgctgtcatttccgggcgtagccaggagcagagtgtgaagacagtccccggagccagcgatcttttttactgtccaaggagagccgggaaactccagggttcccaccacaagcccctgtccaagacggccaatggactggcggggcacgaagggtggacaattgcactcccgggccgggcgctggcccagaatggatccttgggtgaaggaatccatgatcctgggggtccccgccggggaaacagcacgaaccggcgtgtgagactgaagaaccccttctacccgctgacccaggagtcctatggagcctacgcggtcatgtgtctgtccgtggtgatcttcgggaccggcatcattggcaacctggcggtgatgtgcatcgtgtgccacaactactacatgcggagcatctccaactccctcttggccaacctggtcttctgggactttctcatcatcttcttctgccttccgctggtcatcttccacgagctgaccaagaagtggctggtggaggacttctcctgcaagatcgtgccctatatagaggtcgcttctctgggagtcaccactttcaccttatgtgctctgtgcatagaccgcttccgtgctgccaccaacgtacagatgtactacgaaatgatcgaaaactgttcctcaacaactgccaaacttgctgttatatgggtgggagctctattgttagcacttccagaagttgttctccgccagctgagcaaggaggatttggggtttagtggccgagctccggcagaaaggtgcattattaagatctctcctgatttaccagacaccatctatgttctagccctcacctacgacagtgcgagactgtggtggtattttggctgttacttttgtttgcccacgcttttcaccatcacctgctctctagtgactgcgaggaaaatccgcaaagcagagaaagcctgtacccgagggaataaacggcagattcaactagagagtcagatgaactgtacagtagtggcactgaccattttatatggattgggcattattcctgaaaatatctgcaacattgttactgcctacatggctacaggggtttcacagcagacaatggacctccttaatatcatcagccagttccttttgttctttaagtcctgtgtcaccccagtcctccttttctgtctctgcaaacccttcagtcgggccttcatggagtgctgctgctgttgctgtgaggaatgcattcagaagtcttcaacggtgaccagtgatgacaatgacaacgagtacaccacggaactcgaactctcgcctttcagtgccatacgccgtgaaatgtccacttttgcttctgtcggaactcattgctgaaggacagtacttggttgggtcagatttatttgtttgattttcatatcccgtgaaagtttttaattcatatttttccttatagggaaaaatgcaaaaaagaaacaataaagaaagaaatattaactactgtagaactgattttacaaattaatatttgtgctttgaaaaaaagtttctatttagttatttaagaagaatgagaaggccaatagttttagattattttatctggtatggtgctaatattttatttgaaaaaagttactgcaacttaacttaaaattgctaacgttttttcttcttttaaaaatacaattattgtatattaattatagcaatgtgattttgtaggttattttatatttgagttgtgattgaaagtatgttgtatatggtattgtgagatgatttgtacttggaagcattcacaaagtagcaccaaataaattacactttattctttaatgtcattgtcaatctacttttaaccaatattcaataaatcttctaattgccttaaaaaaaaaaaaaaaaaagggctgcaggtttcgacccgcgctggcgagtcatgagcgccaagtttcccactggcgcgcaaacttgagttacttttgagcgtggatactggcgaagaggctgcgggcggtattagcgtttgcagcgacttggctcgggcagctgaccccaaagtgtctgtcttccttcctctgcttgtctctaggctctgaaactgcggcggccaccggacgcttctggagcaggtagcagcatgcagccgcctccaagtctgtgcggacgcgccctggttgcgctggttcttgcctgcggcctgtcgcggatctggggagaggagagaggcttcccgcccgacagggccactccgcttttgcaaaccgcagagataatgacgccacccactaagaccttatggcccaagggttccaacgccagtctggcgcggtcgttggcacctgcggaggtgcctaaaggagacaggacggcaggatctccgccacgcaccatctcccctcccccgtgccaaggacccatcgagatcaaggagactttcaaatacatcaacacggttgtgtcctgccttgtgttcgtgctggggatcatcgggaactccacacttctgagaattatctacaagaacaagtgcatgcgaaacggtcccaatatcttgatcgccagcttggctctgggagacctgctgcacatcgtcattgacatccctatcaatgtctacaagctgctggcagaggactggccatttggagctgagatgtgtaagctggtgcctttcatacagaaagcctccgtgggaatcactgtgctgagtctatgtgctctgagtattgacagatatcgagctgttgcttcttggagtagaattaaaggaattggggttccaaaatggacagcagtagaaattgttttgatttgggtggtctctgtggttctggctgtccctgaagccataggttttgatataattacgatggactacaaaggaagttatctgcgaatctgcttgcttcatcccgttcagaagacagctttcatgcagttttacaagacagcaaaagattggtggctgttcagtttctatttctgcttgccattggccatcactgcatttttttatacactaatgacctgtgaaatgttgagaaagaaaagtggcatgcagattgctttaaatgatcacctaaagcagagacgggaagtggccaaaaccgtcttttgcctggtccttgtctttgccctctgctggcttccccttcacctcagcaggattctgaagctcactctttataatcagaatgatcccaatagatgtgaacttttgagctttctgttggtattggactatattggtatcaacatggcttcactgaattcctgcattaacccaattgctctgtatttggtgagcaaaagattcaaaaactgctttaaggctgggccacatgttggaaataagctagtaatgttgttttctgtcaatattgaatgtgatggtacagtaaaccaaaacccaacaatgtggccagaaagaaagagcaataataattaattcacacaccatatggattctatttataaatcac

SEQ ID NO: 2856 - DNA, 12461 bp; single-stranded, linear
gatatcctattaatacagagatacagaaagaaatacataaaaaatagttttatcaaatactttccagcattcaagtgtagcctcaaaagcaagaataggccaggagtggtggctcacgctgtaatccacagcactgtgggaggccaaggtaagaggattgcttgaggccaggatttcaagaccagcctaggcaacatagtgagatccctatctctacgaaaaaattttaaaacttagctgggcatggtgcttgagcctgttgtcccagctactcaggaggtgaagtaggagtgtcacttgagcccaggaggttgaggctgcagtgagctataactgcaccactgcactccagccttggagacagagtgagaccctgtccccaaaaaaattaaaattgagaaaaaaaaaaaggcaagaacagccacagcaaactttctattggggaaaaaaaaaaatcctcctctttacatctctcccttccttcccttccctttctgagagtgactgtggccaaaaggagcattttccccctgcagtcctctgaggggtggggtggggctatgaagctatccttcatattcactcctttgtccagctcttttcacctctagttcttctccccgcatctctgtctagcagtgccttaagtggaggaggggtgggggcatcaagcttgtaaaactggtttgttggggttctccttctcccctcatttcttgattcttgggaaaatgtcttgctgggaggctgcctggcgagtgccctagctgccttctgtgggcttgaatggggcttccctctgcccctacaggaggaaaagggagctgctgccagagggagaaatggagagatggacagagaaggcaggtgccacccctcgcccctgacacacaaagaaaaagacacggaaattctctctctctcttctcttctcctatctctctctctctccctctctctctctctctctctctctctcacacacacacacacacacacacacacacacacaggcgcgcgccgcgcgcgcaggcacacgtcttgcaaattcaggattcaaagagacaggggcaccattatatttggcacggtggggccttccaggtctgaaatcctgcattcttccttactatttactttccccgagctcgagaagggccaggtgtgggcggatggctggccacgttttgtgtttccaattcatattcacgggatgacacagacggggcgtggtgagtgctgttggaggcgcttgggcagtttcattttgccccacttctccacctgaaggctgggcgttgctggaacctgcaggggcagcctcagcaaggtggggtggcgtggagtggggtgggagaagggactccagctgaagtagaacccaggctggacctgagaatattggggagggcatgggcggtggtttccgggtaggggccttgaggacatgttggtcctgactgttgtcagtgtttggtcaaagttgccaaaaggttaaaaaaaaaaaagtagggggagtccctgccaagacatatttcccaggccacctttcttccgcgggagtgttgggggggaggcgctgcttggaacctgtgaatgtgacatcagctctcctctcctctcccaaggtcggctttggagagggaggtcagggcacccttgcctggcacaggcacgctggcttccggctcagtgccgcctgctctccgggagctgtgcgctccctgggccccggggctaggctgaggtaagcgcacagcggaggccaggcgcgccggcagaggcctgggggatagggtggaggcatctctgggtgtgggtgtgggtgtgggtgtgggagggagagttcttgcctctctctctcccatctccaactcttgcttcagtggctcttttagaggatgcatgtcattatggacctgtcgctgccactgtccctgttcccccagctgtgacttcgagggaggtctggggatctgagtctgtccaaacccacggctttgctgttgggataaaaactgtccttttgattttagaaggaggagggaaaaaaggtttcccagcatgtgtgttgtgccagtcttggaaattcatccgtgcttgaattccaccctccatccccagaaaaactggagtaaaacaaaaagaggagatggacaaagtgtgtatttgatggcatcccctgggaagagactctaaatttatcccataggtcttactgggccactgtgagcgctttggtggagaacaaacaaaaattctgggtgctcagttgtctaacctgaaaaatgggactagcggaaaaagccaatgtgttccatgcaccttttgctttctttattaaggcatgatgtcacctgtacagtaactgccctgtgtgtacttcagggggggatttcaaggttagatagacaggaaattgttttgaaaatgtaaacacattattaaatgtgaagtattatctgattccttgttcgaatggcatttccttctcagcaccaccttccttgcatattcacttaaccttgtacaagaacacctttttgccctaaatgaagacacccccccaaaaaaaagagtcccagaaaatatgtccctgcttgtgcgggaataaatagaatattctgaggtgcattcctccttcctatgttaggcaacattccttgaccctcctcggcccccaagccaggttgcgtttttttctgccatttagaagggttttcctttttgtcctagtaaaacatcagcccctgtagctcttcatctccccctggtgttcttctcccgccatgtcttaagattggtggcaccgaccaatcttaagatttaagttctgtgtgaaaaacacctttgcttttcaatcagtttatcagcctcctccgcaggggaatgtggacacacaaaagaacttatcggggcttctcatcagtgatagggaaaagactggcatgtgcctaaacgagctctgatgttatttttaagctccctttcttgccaatccctcacggatctttctccgatagatgcaaagaacttcagcaaaaaagacccgcaggaaggggcttgaagagaaaagtacgttgatctgccaaaatagtctgacccccagtagtgggcagtgacgagggagagcattcccttgtttgactgagactagaatcggagagacataaaaggaaaatgaagcgagcaacaattaaaaaaaattccccgcacacaacaatacaatctatttaaactgtggctcatacttttcataccaatggtatgactttttttctggagtcccctcttctgattcttgaactccggggctggcagcttgcaaaggggaagcggactccagcactgcacgggcaggtttagcaaaggtctctaatgggtattttctttttcttagccctgcccccgaattgtcagacggcgggcgtctgcttctgaagttagcagtgatttcctttcgggcctggcttatctccggctgcacgttgcctgttggtgactaataacacaataacattgtctggggctggaataaagtcggagctgtttacccccactctaataggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacaggtaggcacgctcgttgacttgtaagtctcggaattacaagttagtgtgttcttatccaccttcatgcttttcttgcttctatttttccccgttctttttatgactgcagcttagagagcaagtgtctgagaattattgctgaaacgtactttaagtcttctagtgtaaaatgtaaaattcctctactgaatacaattaggtgcaattgactataacatgacattaaaataacttatcgttttattattattattccattatgtgtttccttggcttttaaaaaatgagaagagtatggacatatacaatttagtcaaatgtatgtttgtaatatatgtgtttatacaggtacacaggccatataggaacttaaatcttatttaaacactattttaatagtgtgttaacgtgtaaaatatttaagcattccagcttgaagccaaggaattgtatccagtcgttcaagcaatgtatgttcagtaaaatcacctgcagagcaaaagtctgttgactaactaccgcctcccccgcccccccaccaccccccgcaggcggtttctgggtgaagcagatgttttctttaaaatttgtcatcattgactttaggtttcttttggcaggtttttggcacccaaaacagtgtgagctctcttttcagctttattcacctgtgctgggaggggagctaggataattcttggctgccgaaggatttaggcagtgcgtgtgcatctgcccgggtcccccccgtttttagggtcagtgcactttttttgtcttttcgtgaccctgactaaagagaaaggatgtcaagggaatgaaaatcctggaatgtgtctgatcatttgaaatgtacaaaattgggcagataagctgcatggctaaattgttaggaggaagaggcaaggcagtagtggagaagggggaggcagtggatcccacacaagcctgatgcccagggattcggaattcaaaatccccccagcctaccttcagtcccctgacctgcttctcagccccaccttaggtcactggtttctatggagttaccctactgaattgaatattgaatagttaatttctctctccaatcattttccccacctaattttgaaagatatacatcatctggggtaccctgtgccctacacagcatgtgaagtggatgggtaccccctaaagagagggtcatcctgaatggggaagtggccccaaagctaggaataactgtgatttcttgtctttagtcatgtgccaatgttaagtaagcttcagtggatagtgctgtcctaccaagttccttgtagaagccagccggattttcaacaggcagcattccacagcatttccctgagcctgcttcaagaggggtgggggaagtcccttttcaggtgtttatctcctctgcatttgtgtaatctccctgaaggtggataagccaagggcatgagggggaggcaaaaggtgaactcatgttaaggagggaaaaaaataaagagcccttttttctgtgtttcttgctgatggcaggctgtgtgcttcatctgcttttatctgctctgctagctctgactctactgtgatccagcatgtctctcggcgtttgaggagacatcccccactgacctgctctttctctccccagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagtaagtctctagagggcattgtaaccctattcattcattagcgctggctccactggagcccagttttagagtttcttttctagggactctgaaggtagtccttctaacaccatccaagtgcctcagtggggacagtttccctctattcctgaaaataacgacagcttcgttcttagcaaccaaggggagggtcttctgaggccccgtagctcaggctactcatgatgggacaagcaggaggccactgcacgtttcaaatgaggaactttcagtgagagggcctcagggggacactctcacagtggcatctgatggggtttcgggaataattgccgaggtcagatgtgggttagtgcaacctgtgcttctcatgggagggtggagactgagaggcagaagtgatgatatagagggttagaatcacttaattttagttacagaaaaacctaggctcaaagtgttgaagccatttgtgcaggagtgagtttgtagcagagctagaactggagcccggatttcctttgctgctatattttccctttagaaatgcccatttcagaactgaaatagaaatactgtccataggcttctctttcacctacagagaagaaaagcagatttcctccttctgccctggacactagttcatcatctgtcggaagcagtcataaacaagcacacatttactatgcatacaatgtaccgttatgacaaaggaggaccaaaatccaaacaatatcaaaccacaccaaaaaccacaaggagcctaataattactaaggtgatacttccaaagggaggactttatttcttagatgagaatgaaaatggacacattggaaattattggagagccctctggctatgagtccttccacaaccatatggtaccaccgactggcaggagaaatgtgtgaacatgtgcctcctctccccaaccactggggccggtggggtgacggtggcacttttagcagtatcctccgtggtttgagttgaaaataagttttaaaaatcctgtgagtcatggttttgcattgaaacctcttcccactgtgtacccacaaatagttaactaaatagaccattagaaaaggaagaaaatataaagcagatgccaagcagagatgtcctaatttttgacaaaaaagcaatgttgcttgtgtcaagaagaaactgaactttgtgaagagttgaaatggaattccactgaattagaaaaacttgttttctcctgcctggatacatacagtcagggccattgatgcacaggtgttcctggctgttgttacactttaccctctgaaatgatgctcccaagtgctatgtgatgagctccttgtgtgcccagtggaataggtgtgtccatgtgtcattttaaagactattaattacactaatatagtttctttctctctttggataataggcacgttgttccgtatggacttggaagccctaggtccaagagagccttggagaatttacttcccacaaaggcaacagaccgtgagaatagatgccaatgtgctagccaaaaagacaagaagtgctggaatttttgccaagcaggaaaagaactcaggtgagcagaaacacctttgcttttcaatcagtttaacagcctcctgaactccttcctatcatggtactgccttcctgttttagagagactaacagagacattgaaagtcagggtaaagctgaatataacattgctgaaatgtttttccttgtgtattttaacagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtaagagggaaggaagaaaaattaggtaagaggttcacaagaacaactagccccagtcagtgatgccagcagcctgttcctccagcccttcttacccgggcaggtgaaagacttagaaaacagtagcagaggagatctatgcatcctatagattaaaaggagcaaaagaatccctcttaaatatttccatgaagctctggaatgcaaaccgatgtcctctgtacctttagcacataccatttcatctacaggtagatttcccaaccaaaatatatccagagatgcctttgtcattgggttatatacagcctttgcctctctgagtcaatgtatttaccactttccctgagaaatcgaaaatcattttggggagcggacatttagaaaaagaatcaaagtgtcatggataatcaaattcttcaataagttgcagttattcagatggccaaaggaaaaataaagtcattagatagggttggtagaatttagaacatgctgtttttcaggtttatggtctttttttttttttttttttttttttaaatagggaaatgtgtttggtgcagagccaatgtcattccaaaaagctctctcttttcctggtcagtcatgtgctgggacagagaagggatctggattaggcaacatcatagagttgctctgagctgctctttggtgataacccttccaaatcctaaactttttggaattcacaagctcaaaggaggaaacctactctctgatctaccacatgttctgcatttttctatcatggtctatggaaacttctcttagaaatccagtggcaagaagttctatgattaaagtgttctgagctcaggccaggcagtcatgaactacttctgagttgtttactactgatttgtggggcagcctcagctatcggtttcttcacacctgcttatgagagtatccatatttatggtcgcaggcagtaatgctccccacgagatcagtttctgaactaacctggaattttttatgggtttttattatgccaactattaaatcaacattacagttcttccctctgtatttctcctgtaaaacattaggcctgcaaaaaaaaaaaatctttttaaaaataattgccataaagtatttgctctgggcctactgtatgcttcttttytttttctctcttttcaactaagtcaccgtcaatttattaagatggccataactattcaaaacctatgctgagttcctcaaggcagggtcgcatagtgatgaaggttgggatggggctacggaagaaaccagaacaactctagtttatttaaaacctgtatttactgcccacttccccttagacttgaccatatgaccccttgctccccattctaagcataggggcaggctttatttttacaatggtaatagatgatatcacttgaggttttatcaaagagttgcggcgggtggtgaaagttcacaaccagattcaggttttgtttgtgccagattctaattttacatgtttcttttgccaaagggtgatttttttaaaataacatttgttttctcttatcttgctttattaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcgggtggcatcctccggagagagagagaggaaggagattccacacaggggtggagtttctgacgaaggtcctaagggagtgtttgtgtctgactcaggcgcctggcacatttcagggagaaactccaaagtccacacaaagattttctaaggaatgcacaaattgaaaacacactcaaaagacaaacatgcaagtaaagaaaaaaaaaagaaagacttttgtttaaatttgtaaaatgcaaaactgaatgaaactgttactaccataaatcaggatatgtttcatgaatatgagtctacctcacctatattgcactctggcagaagtatttcccacatttaattattgcctccccaaactcttcccacccctgctgccccttcctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatgactttagaaaataaatatttttttccttactgtactgatttggaatcattactgaaatttgtaaggagtgggccaacgtgattaagtaccataaaggcaaataaatggttaaagacggtttcatagaaaagtgacaattagaaggatattacggtctaagctaattatataaagaattttatctgtatcttaaatgttgattttatactgcattgaggtaaaaacacaaaacaaaaaagcagctttaacacctctgtcttctcttgggtagcagcctcctgcttctccttcacctgaaaaattctccagggacttcatccattaacttggctcaggctattggcaggattcacagtttaagctgatggtgtggtgagagatgctttatccatattaatggactgaaggaagtaatggcaagacaaccccccaaaacatacctaattatacaaagttatataccaaagttgcttttagaaaatggcctgctcagagcaagtagaggtttccaatggctttttattttctcacattaaggatgttgtttcttaaggaacattgagtaccattgcttcttcgtgatagcctaggactgccgtgtgcccatggaggtagagacaccaggtactgattctaggtcctctgccacaaagcaccacttcctctccactttgccttggctggccttgtcagctcactggagagcacagtattgcaattgcagtattgcaaatggtcactactaactgaattctctaagagcttgattagccctcgagaatcttccttgcccttctctaatagtgtctgaaggaattcctggcatttaacaaatattagcatgtagtgatcactgtcgtcctaacagtgacacatcagaaggatttcaaataacagtcttcaggcatgcgtaatcaatgtcctgtgcagagtctccgtcctcattgatcctcatttttctctttaaggcacagtccaatgtctttggggaattgtttataaagcttactttatccataaactgtttctcagtgcgtgactctgaagaaaattttgaagttttgcccatgttgacaaggtgcttggtctgaacttggccagtatttaatcttgagcaaacgattcaatttccttctatcgtgagttttctcatctatgaaacaagggagttgaggggagtttctttcatacctctgagaaagagtttgagattacataaagaagttgaagtggcatgaaaaaaaataaagatctgagcttagaagacatggatctaatacatttaagaggaagtcagaatcagagaagccactgaacaaaacagtccaaacggagcatagtaagtcagattgatgagttttggttgggtttttcatcagtcaaacccttgagcccccctttcccatgcttcctgcttcagtatccagtaggaaaaatgaaagggatgatgtagacactctagggcatgaggatttgcagtaaataagttgggagactcacagaaaattaatatttttcaaacatgaagacgaaacattcaattatattacagtccacatcagcttgaagggtaaactgatgggatgatctgtcacatttcttgctctgtttccagtaaaagcatggtttctggaaacccacttaggacagctttctctctttacactgatagcccaggcaagctttgatctcagaactccagaaaccagagaactctaggtggaatgtggtaacttttgccagggcagagggaacacctactaataggtacttcatttgcaccaccagagattggcatcttttttgatggatccactggctttgatactgcctgtactcccccaaaacacagcttgggtattggactaatctagagctccctcaggagaactcttgctgacattaagaaagagcaacattttgtctttccaggtgaaaatccaaggccaaaaagggagtgactcacctaagatcacagaaggagctgtagcatctctggagcctgaacacttaagttaagcacgactatttcacgcagagggcatgaattc

SEQ ID NO: 2857 - DNA, 1251 bp; single-stranded, linear
ggagctgtttacccccactctaataggggttcaatataaaaagccggcagagagctgtccaagtcagacgcgcctctgcatctgcgccaggcgaacgggtcctgcgcctcctgcagtcccagctctccaccaccgccgcgtgcgcctgcagacgctccgctcgctgccttctctcctggcaggcgctgccttttctccccgttaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgagaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagacttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattc

SEQ ID NO: 2858 - DNA, 1167 bp; single-stranded, linear
ctgcgccaggcgaacgggtcctgcgcctcctgcagtcccagctctccaccgccgcgtgcgcctgcagacgctccgctcgctgccttctctcctggcaggcgctgccttttctccccgttaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgagaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagacttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattc

SEQ ID NO: 2859 - DNA, 14879 bp; single-stranded, linear
gatatcctattaatacagagatacagaaagaaatacataaaaaatagttttatcaaatactttccagcattcaagtgtagcctcaaaagcaagaataggccaggagtggtggctcacgctgtaatccacagcactgtgggaggccaaggtaagaggattgcttgaggccaggatttcaagaccagcctaggcaacatagtgagatccctatctctacgaaaaaattttaaaacttagctgggcatggtgcttgagcctgttgtcccagctactcaggaggtgaagtaggagtgtcacttgagcccaggaggttgaggctgcagtgagctataactgcaccactgcactccagccttggagacagagtgagaccctgtccccaaaaaaattaaaattgagaaaaaaaaaaaggcaagaacagccacagcaaactttctattggggaaaaaaaaaaatcctcctctttacatctctcccttccttcccttccctttctgagagtgactgtggccaaaaggagcattttccccctgcagtcctctgaggggtggggtggggctatgaagctatccttcatattcactcctttgtccagctcttttcacctctagttcttctccccgcatctctgtctagcagtgccttaagtggaggaggggtgggggcatcaagcttgtaaaactggtttgttggggttctccttctcccctcatttcttgattcttgggaaaatgtcttgctgggaggctgcctggcgagtgccctagctgccttctgtgggcttgaatggggcttccctctgcccctacaggaggaaaagggagctgctgccagagggagaaatggagagatggacagagaaggcaggtgccacccctcgcccctgacacacaaagaaaaagacacggaaattctctctctctcttctcttctcctatctctctctctctccctctctctctctctctctctctctctcacacacacacacacacacacacacacacacacaggcgcgcgccgcgcgcgcaggcacacgtcttgcaaattcaggattcaaagagacaggggcaccattatatttggcacggtggggccttccaggtctgaaatcctgcattcttccttactatttactttccccgagctcgagaagggccaggtgtgggcggatggctggccacgttttgtgtttccaattcatattcacgggatgacacagacggggcgtggtgagtgctgttggaggcgcttgggcagtttcattttgccccacttctccacctgaaggctgggcgttgctggaacctgcaggggcagcctcagcaaggtggggtggcgtggagtggggtgggagaagggactccagctgaagtagaacccaggctggacctgagaatattggggagggcatgggcggtggtttccgggtaggggccttgaggacatgttggtcctgactgttgtcagtgtttggtcaaagttgccaaaaggttaaaaaaaaaaaagtagggggagtccctgccaagacatatttcccaggccacctttcttccgcgggagtgttgggggggaggcgctgcttggaacctgtgaatgtgacatcagctctcctctcctctcccaaggtcggctttggagagggaggtcagggcacccttgcctggcacaggcacgctggcttccggctcagtgccgcctgctctccgggagctgtgcgctccctgggccccggggctaggctgaggtaagcgcacagcggaggccaggcgcgccggcagaggcctgggggatagggtggaggcatctctgggtgtgggtgtgggtgtgggtgtgggagggagagttcttgcctctctctctcccatctccaactcttgcttcagtggctcttttagaggatgcatgtcattatggacctgtcgctgccactgtccctgttcccccagctgtgacttcgagggaggtctggggatctgagtctgtccaaacccacggctttgctgttgggataaaaactgtccttttgattttagaaggaggagggaaaaaaggtttcccagcatgtgtgttgtgccagtcttggaaattcatccgtgcttgaattccaccctccatccccagaaaaactggagtaaaacaaaaagaggagatggacaaagtgtgtatttgatggcatcccctgggaagagactctaaatttatcccataggtcttactgggccactgtgagcgctttggtggagaacaaacaaaaattctgggtgctcagttgtctaacctgaaaaatgggactagcggaaaaagccaatgtgttccatgcaccttttgctttctttattaaggcatgatgtcacctgtacagtaactgccctgtgtgtacttcagggggggatttcaaggttagatagacaggaaattgttttgaaaatgtaaacacattattaaatgtgaagtattatctgattccttgttcgaatggcatttccttctcagcaccaccttccttgcatattcacttaaccttgtacaagaacacctttttgccctaaatgaagacacccccccaaaaaaaagagtcccagaaaatatgtccctgcttgtgcgggaataaatagaatattctgaggtgcattcctccttcctatgttaggcaacattccttgaccctcctcggcccccaagccaggttgcgtttttttctgccatttagaagggttttcctttttgtcctagtaaaacatcagcccctgtagctcttcatctccccctggtgttcttctcccgccatgtcttaagattggtggcaccgaccaatcttaagatttaagttctgtgtgaaaaacacctttgcttttcaatcagtttatcagcctcctccgcaggggaatgtggacacacaaaagaacttatcggggcttctcatcagtgatagggaaaagactggcatgtgcctaaacgagctctgatgttatttttaagctccctttcttgccaatccctcacggatctttctccgatagatgcaaagaacttcagcaaaaaagacccgcaggaaggggcttgaagagaaaagtacgttgatctgccaaaatagtctgacccccagtagtgggcagtgacgagggagagcattcccttgtttgactgagactagaatcggagagacataaaaggaaaatgaagcgagcaacaattaaaaaaaattccccgcacacaacaatacaatctatttaaactgtggctcatacttttcataccaatggtatgactttttttctggagtcccctcttctgattcttgaactccggggctggcagcttgcaaaggggaagcggactccagcactgcacgggcaggtttagcaaaggtctctaatgggtattttctttttcttagccctgcccccgaattgtcagacggcgggcgtctgcttctgaagttagcagtgatttcctttcgggcctggcttatctccggctgcacgttgcctgttggtgactaataacacaataacattgtctggggctggaataaagtcggagctgtttacccccactctaataggggttcaatataaaaagccggcagagagctgtccaagtcagacgcgcctctgcatctgcgccaggcgaacgggtcctgcgcctcctgcagtcccagctctccaccgccgcgtgcgcctgcagacgctccgctcgctgccttctctcctggcaggcgctgccttttctccccgttaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacaggtaggcacgctcgttgacttgtaagtctcggaattacaagttagtgtgttcttatccaccttcatgcttttcttgcttctatttttccccgttctttttatgactgcagcttagagagcaagtgtctgagaattattgctgaaacgtactttaagtcttctagtgtaaaatgtaaaattcctctactgaatacaattaggtgcaattgactataacatgacattaaaataacttatcgttttattattattattccattatgtgtttccttggcttttaaaaaatgagaagagtatggacatatacaatttagtcaaatgtatgtttgtaatatatgtgtttatacaggtacacaggccatataggaacttaaatcttatttaaacactattttaatagtgtgttaacgtgtaaaatatttaagcattccagcttgaagccaaggaattgtatccagtcgttcaagcaatgtatgttcagtaaaatcacctgcagagcaaaagtctgttgactaactaccgcctcccccgcccccccaccaccccccgcaggcggtttctgggtgaagcagatgttttctttaaaatttgtcatcattgactttaggtttcttttggcaggtttttggcacccaaaacagtgtgagctctcttttcagctttattcacctgtgctgggaggggagctaggataattcttggctgccgaaggatttaggcagtgcgtgtgcatctgcccgggtcccccccgtttttagggtcagtgcactttttttgtcttttcgtgaccctgactaaagagaaaggatgtcaagggaatgaaaatcctggaatgtgtctgatcatttgaaatgtacaaaattgggcagataagctgcatggctaaattgttaggaggaagaggcaaggcagtagtggagaagggggaggcagtggatcccacacaagcctgatgcccagggattcggaattcaaaatccccccagcctaccttcagtcccctgacctgcttctcagccccaccttaggtcactggtttctatggagttaccctactgaattgaatattgaatagttaatttctctctccaatcattttccccacctaattttgaaagatatacatcatctggggtaccctgtgccctacacagcatgtgaagtggatgggtaccccctaaagagagggtcatcctgaatggggaagtggccccaaagctaggaataactgtgatttcttgtctttagtcatgtgccaatgttaagtaagcttcagtggatagtgctgtcctaccaagttccttgtagaagccagccggattttcaacaggcagcattccacagcatttccctgagcctgcttcaagaggggtgggggaagtcccttttcaggtgtttatctcctctgcatttgtgtaatctccctgaaggtggataagccaagggcatgagggggaggcaaaaggtgaactcatgttaaggagggaaaaaaataaagagcccttttttctgtgtttcttgctgatggcaggctgtgtgcttcatctgcttttatctgctctgctagctctgactctactgtgatccagcatgtctctcggcgtttgaggagacatcccccactgacctgctctttctctccccagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagtaagtctctagagggcattgtaaccctattcattcattagcgctggctccactggagcccagttttagagtttcttttctagggactctgaaggtagtccttctaacaccatccaagtgcctcagtggggacagtttccctctattcctgaaaataacgacagcttcgttcttagcaaccaaggggagggtcttctgaggccccgtagctcaggctactcatgatgggacaagcaggaggccactgcacgtttcaaatgaggaactttcagtgagagggcctcagggggacactctcacagtggcatctgatggggtttcgggaataattgccgaggtcagatgtgggttagtgcaacctgtgcttctcatgggagggtggagactgagaggcagaagtgatgatatagagggttagaatcacttaattttagttacagaaaaacctaggctcaaagtgttgaagccatttgtgcaggagtgagtttgtagcagagctagaactggagcccggatttcctttgctgctatattttccctttagaaatgcccatttcagaactgaaatagaaatactgtccataggcttctctttcacctacagagaagaaaagcagatttcctccttctgccctggacactagttcatcatctgtcggaagcagtcataaacaagcacacatttactatgcatacaatgtaccgttatgacaaaggaggaccaaaatccaaacaatatcaaaccacaccaaaaaccacaaggagcctaataattactaaggtgatacttccaaagggaggactttatttcttagatgagaatgaaaatggacacattggaaattattggagagccctctggctatgagtccttccacaaccatatggtaccaccgactggcaggagaaatgtgtgaacatgtgcctcctctccccaaccactggggccggtggggtgacggtggcacttttagcagtatcctccgtggtttgagttgaaaataagttttaaaaatcctgtgagtcatggttttgcattgaaacctcttcccactgtgtacccacaaatagttaactaaatagaccattagaaaaggaagaaaatataaagcagatgccaagcagagatgtcctaatttttgacaaaaaagcaatgttgcttgtgtcaagaagaaactgaactttgtgaagagttgaaatggaattccactgaattagaaaaacttgttttctcctgcctggatacatacagtcagggccattgatgcacaggtgttcctggctgttgttacactttaccctctgaaatgatgctcccaagtgctatgtgatgagctccttgtgtgcccagtggaataggtgtgtccatgtgtcattttaaagactattaattacactaatatagtttctttctctctttggataataggcacgttgttccgtatggacttggaagccctaggtccaagagagccttggagaatttacttcccacaaaggcaacagaccgtgagaatagatgccaatgtgctagccaaaaagacaagaagtgctggaatttttgccaagcaggaaaagaactcaggtgagcagaaacacctttgcttttcaatcagtttaacagcctcctgaactccttcctatcatggtactgccttcctgttttagagagactaacagagacattgaaagtcagggtaaagctgaatataacattgctgaaatgtttttccttgtgtattttaacagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtaagagggaaggaagaaaaattaggtaagaggttcacaagaacaactagccccagtcagtgatgccagcagcctgttcctccagcccttcttacccgggcaggtgaaagacttagaaaacagtagcagaggagatctatgcatcctatagattaaaaggagcaaaagaatccctcttaaatatttccatgaagctctggaatgcaaaccgatgtcctctgtacctttagcacataccatttcatctacaggtagatttcccaaccaaaatatatccagagatgcctttgtcattgggttatatacagcctttgcctctctgagtcaatgtatttaccactttccctgagaaatcgaaaatcattttggggagcggacatttagaaaaagaatcaaagtgtcatggataatcaaattcttcaataagttgcagttattcagatggccaaaggaaaaataaagtcattagatagggttggtagaatttagaacatgctgtttttcaggtttatggtctttttttttttttttttttttttttaaatagggaaatgtgtttggtgcagagccaatgtcattccaaaaagctctctcttttcctggtcagtcatgtgctgggacagagaagggatctggattaggcaacatcatagagttgctctgagctgctctttggtgataacccttccaaatcctaaactttttggaattcacaagctcaaaggaggaaacctactctctgatctaccacatgttctgcatttttctatcatggtctatggaaacttctcttagaaatccagtggcaagaagttctatgattaaagtgttctgagctcaggccaggcagtcatgaactacttctgagttgtttactactgatttgtggggcagcctcagctatcggtttcttcacacctgcttatgagagtatccatatttatggtcgcaggcagtaatgctccccacgagatcagtttctgaactaacctggaattttttatgggtttttattatgccaactattaaatcaacattacagttcttccctctgtatttctcctgtaaaacattaggcctgcaaaaaaaaaaaatctttttaaaaataattgccataaagtatttgctctgggcctactgtatgcttcttttytttttctctcttttcaactaagtcaccgtcaatttattaagatggccataactattcaaaacctatgctgagttcctcaaggcagggtcgcatagtgatgaaggttgggatggggctacggaagaaaccagaacaactctagtttatttaaaacctgtatttactgcccacttccccttagacttgaccatatgaccccttgctccccattctaagcataggggcaggctttatttttacaatggtaatagatgatatcacttgaggttttatcaaagagttgcggcgggtggtgaaagttcacaaccagattcaggttttgtttgtgccagattctaattttacatgtttcttttgccaaagggtgatttttttaaaataacatttgttttctcttatcttgctttattaggtcggagaccatgagaaacagcgtcaaatcatcttttcatgatcccaagctgaaaggcaagccctccagagagcgttatgtgacccacaaccgagcacattggtgacagaccttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcgggtggcatcctccggagagagagagaggaaggagattccacacaggggtggagtttctgacgaaggtcctaagggagtgtttgtgtctgactcaggcgcctggcacatttcagggagaaactccaaagtccacacaaagattttctaaggaatgcacaaattgaaaacacactcaaaagacaaacatgcaagtaaagaaaaaaaaaagaaagacttttgtttaaatttgtaaaatgcaaaactgaatgaaactgttactaccataaatcaggatatgtttcatgaatatgagtctacctcacctatattgcactctggcagaagtatttcccacatttaattattgcctccccaaactcttcccacccctgctgccccttcctccatcccccatactaaatcctagcctcgtagaagtctggtctaatgtgtcagcagtagatataatattttcatggtaatctactagctctgatccataagaaaaaaaagatcattaaatcaggagattccctgtccttgatttttggagacacaatggtatagggttgtttatgaaatatattgaaaagtaagtgtttgttacgctttaaagcagtaaaattattttcctttatataaccggctaatgaaagaggttggattgaattttgatgtacttatttttttatagatatttatattcaaacaatttattccttatatttaccatgttaaatatctgtttgggcaggccatattggtctatgtatttttaaaatatgtatttctaaatgaaattgagaacatgctttgttttgcctgtcaaggtaatgactttagaaaataaatatttttttccttactgtactgatttggaatcattactgaaatttgtaaggagtgggccaacgtgattaagtaccataaaggcaaataaatggttaaagacggtttcatagaaaagtgacaattagaaggatattacggtctaagctaattatataaagaattttatctgtatcttaaatgttgattttatactgcattgaggtaaaaacacaaaacaaaaaagcagctttaacacctctgtcttctcttgggtagcagcctcctgcttctccttcacctgaaaaattctccagggacttcatccattaacttggctcaggctattggcaggattcacagtttaagctgatggtgtggtgagagatgctttatccatattaatggactgaaggaagtaatggcaagacaaccccccaaaacatacctaattatacaaagttatataccaaagttgcttttagaaaatggcctgctcagagcaagtagaggtttccaatggctttttattttctcacattaaggatgttgtttcttaaggaacattgagtaccattgcttcttcgtgatagcctaggactgccgtgtgcccatggaggtagagacaccaggtactgattctaggtcctctgccacaaagcaccacttcctctccactttgccttggctggccttgtcagctcactggagagcacagtattgcaattgcagtattgcaaatggtcactactaactgaattctctaagagcttgattagccctcgagaatcttccttgcccttctctaatagtgtctgaaggaattcctggcatttaacaaatattagcatgtagtgatcactgtcgtcctaacagtgacacatcagaaggatttcaaataacagtcttcaggcatgcgtaatcaatgtcctgtgcagagtctccgtcctcattgatcctcatttttctctttaaggcacagtccaatgtctttggggaattgtttataaagcttactttatccataaactgtttctcagtgcgtgactctgaagaaaattttgaagttttgcccatgttgacaaggtgcttggtctgaacttggccagtatttaatcttgagcaaacgattcaatttccttctatcgtgagttttctcatctatgaaacaagggagttgaggggagtttctttcatacctctgagaaagagtttgagattacataaagaagttgaagtggcatgaaaaaaaataaagatctgagcttagaagacatggatctaatacatttaagaggaagtcagaatcagagaagccactgaacaaaacagtccaaacggagcatagtaagtcagattgatgagttttggttgggtttttcatcagtcaaacccttgagcccccctttcccatgcttcctgcttcagtatccagtaggaaaaatgaaagggatgatgtagacactctagggcatgaggatttgcagtaaataagttgggagactcacagaaaattaatatttttcaaacatgaagacgaaacattcaattatattacagtccacatcagcttgaagggtaaactgatgggatgatctgtcacatttcttgctctgtttccagtaaaagcatggtttctggaaacccacttaggacagctttctctctttacactgatagcccaggcaagctttgatctcagaactccagaaaccagagaactctaggtggaatgtggtaacttttgccagggcagagggaacacctactaataggtacttcatttgcaccaccagagattggcatcttttttgatggatccactggctttgatactgcctgtactcccccaaaacacagcttgggtattggactaatctagagctccctcaggagaactcttgctgacattaagaaagagcaacattttgtctttccaggtgaaaatccaaggccaaaaagggagtgactcacctaagatcacagaaggagctgtagcatctctggagcctgaacacttaagttaagcacgactatttcacgcagagggcatgaattcggagctgtttacccccactctaataggggttcaatataaaaagccggcagagagctgtccaagtcagacgcgcctctgcatctgcgccaggcgaacgggtcctgcgcctcctgcagtcccagctctccaccaccgccgcgtgcgcctgcagacgctccgctcgctgccttctctcctggcaggcgctgccttttctccccgttaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgagaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagacttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattcctgcgccaggcgaacgggtcctgcgcctcctgcagtcccagctctccaccgccgcgtgcgcctgcagacgctccgctcgctgccttctctcctggcaggcgctgccttttctccccgttaaagggcacttgggctgaaggatcgctttgagatctgaggaacccgcagcgctttgagggacctgaagctgtttttcttcgttttcctttgggttcagtttgaacgggaggtttttgatccctttttttcagaatggattatttgctcatgattttctctctgctgtttgtggcttgccaaggagctccagaaacagcagtcttaggcgctgagctcagcgcggtgggtgagaacggcggggagaaacccactcccagtccaccctggcggctccgccggtccaagcgctgctcctgctcgtccctgatggataaagagtgtgtctacttctgccacctggacatcatttgggtcaacactcccgagcacgttgttccgtatggacttggaagccctaggtccaagagagccttggagaatttacttcccacaaaggcaacagaccgtgagaatagatgccaatgtgctagccaaaaagacaagaagtgctggaatttttgccaagcaggaaaagaactcagggctgaagacattatggagaaagactggaataatcataagaaaggaaaagactgttccaagcttgggaaaaagtgtatttatcagcagttagtgagaggaagaaaaatcagaagaagttcagaggaacacctaagacaaaccaggtcggagaccatgagaaacagcgtcaaatcatcttttcatgatcccaagctgaaaggcaagccctccagagagcgttatgtgacccacaaccgagcacattggtgacagacttcggggcctgtctgaagccatagcctccacggagagccctgtggccgactctgcactctccaccctggctgggatcagagcaggagcatcctctgctggttcctgactggcaaaggaccagcgtcctcgttcaaaacattccaagaaaggttaaggagttcccccaaccatcttcactggcttccatcagtggtaactgctttggtctcttctttcatctggggatgacaatggacctctcagcagaaacacacagtcacattcgaattc

SEQ ID NO: 2860 - DNA, 718 bp; single-stranded, linear
aggggcagctggatcagttctcacaggagccacagctcagagactgggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacgctgccctcataacagaactctcaacaattgtcatcggagtagattccgggtgcctttactccactgtgacctcataaatccaggtgcacagaatatttcaaactgcaggtatgcagacagaccaggaaggaggttctatgtagttgcatgtgacaacagagatccacgggattctccacggtatcctgtggttccagttcacctggataccaccatctaagctcctgtatcagcagtcctcatcatcactcatctgccaagctcctcaatcatagccaagatcccatccctccatgtactctgggtatcagcaactgtcctcatcagtctccataccccttcagctttcctgagctgaagtcccttgtgaaccctgcaataaactgctttgcaaattcaaaaa

SEQ ID NO: 2861 - DNA, 715 bp; single-stranded, linear
gaacaaccagctggatcagttctcacaggagccacagctcagagactgggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacgctgccctcataacagaactctcaacaattgtcatcggagtagattccgggtgcctttactccactgtgacctcataaatccaggtgcacagaatatttcaaactgcaggtatgcagacagaccaggaaggaggttctatgtagttgcatgtgacaacagagatccacgggattctccacggtatcctgtggttccagttcacctggataccaccatctaagctcctgtatcagcagtcctcatcatcactcatctgccaagctcctcaatcatagccaagatcccatccctccatgtactctgggtatcagcaactgtcctcatcagtctccataccccttcagctttcctgagctgaagtcccttgtgaaccctgcaataaactgctttgcaaattc

SEQ ID NO: 2862 - DNA, 1452 bp; single-stranded, linear
ctgccagcagcgtatagttttcacccagagtccagatcccaccggcaaaactctgtctaacacaggatgacttggaattagagtccgtatagcagaaagagcagcagggctgtccttgggtatccgttgctcagccaagtcatcaaataaaaaggatgattgcacaagtggaccatgtgtcaatctgtgggtttctgcatggccagacccaccaagggaagctttatttaaacagttccaagtaggggagaccagctgcccctgaaccccagaacaaccagctggatcagttctcacaggagccacagctcagagactgggtaagtcaacaatccccagagctgggacaggaggggcagcgacagggcagcacctgagggagaggtgagctgaagttagtgcttaggagatgtggcacactttggggacaggaagaaaaggaaatgcgaccccagagtggcagcagaggggcctgtgggttgagacactatagagtgtgtcataaccgagaccggataggggagtagttacttctcttcttttcttacaggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacgctgccctcataacagaactctcaacaattgtcatcggagtagattccgggtgcctttactccactgtgacctcataaatccaggtgcacagaatatttcaaactgcaggtatgcagacagaccaggaaggaggttctatgtagttgcatgtgacaacagagatccacgggattctccacggtatcctgtggttccagttcacctggataccaccatctaagctcctgtatcagcagtcctcatcatcactcatctgccaagctcctcaatcatagccaagatcccatccctccatgtactctgggtatcagcaactgtcctcatcagtctccataccccttcagctttcctgagctgaagtcccttgtgaaccctgcaataaactgctttgcaaattcatctggaagtgtctgtgtgtcttcctcggccgctctgctgtcatttagtgacaatctgctctagagatttgggtttatcatgaatctctccccctcaatatctgaccaaattccttgattcccccatcatccttcatgtgatacctgattccaggcctgccttaaaaaaaaatccaattgagtcaacttagcattggtctccctagccttaatatctcctctaagcaattttccat

SEQ ID NO: 2863 - DNA, 2885 bp; single-stranded, linear
aggggcagctggatcagttctcacaggagccacagctcagagactgggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacgctgccctcataacagaactctcaacaattgtcatcggagtagattccgggtgcctttactccactgtgacctcataaatccaggtgcacagaatatttcaaactgcaggtatgcagacagaccaggaaggaggttctatgtagttgcatgtgacaacagagatccacgggattctccacggtatcctgtggttccagttcacctggataccaccatctaagctcctgtatcagcagtcctcatcatcactcatctgccaagctcctcaatcatagccaagatcccatccctccatgtactctgggtatcagcaactgtcctcatcagtctccataccccttcagctttcctgagctgaagtcccttgtgaaccctgcaataaactgctttgcaaattcaaaaagaacaaccagctggatcagttctcacaggagccacagctcagagactgggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacgctgccctcataacagaactctcaacaattgtcatcggagtagattccgggtgcctttactccactgtgacctcataaatccaggtgcacagaatatttcaaactgcaggtatgcagacagaccaggaaggaggttctatgtagttgcatgtgacaacagagatccacgggattctccacggtatcctgtggttccagttcacctggataccaccatctaagctcctgtatcagcagtcctcatcatcactcatctgccaagctcctcaatcatagccaagatcccatccctccatgtactctgggtatcagcaactgtcctcatcagtctccataccccttcagctttcctgagctgaagtcccttgtgaaccctgcaataaactgctttgcaaattcctgccagcagcgtatagttttcacccagagtccagatcccaccggcaaaactctgtctaacacaggatgacttggaattagagtccgtatagcagaaagagcagcagggctgtccttgggtatccgttgctcagccaagtcatcaaataaaaaggatgattgcacaagtggaccatgtgtcaatctgtgggtttctgcatggccagacccaccaagggaagctttatttaaacagttccaagtaggggagaccagctgcccctgaaccccagaacaaccagctggatcagttctcacaggagccacagctcagagactgggtaagtcaacaatccccagagctgggacaggaggggcagcgacagggcagcacctgagggagaggtgagctgaagttagtgcttaggagatgtggcacactttggggacaggaagaaaaggaaatgcgaccccagagtggcagcagaggggcctgtgggttgagacactatagagtgtgtcataaccgagaccggataggggagtagttacttctcttcttttcttacaggaaacatggttccaaaactgttcacttcccaaatttgtctgcttcttctgttggggcttatgggtgtggagggctcactccatgccagacccccacagtttacgagggctcagtggtttgccatccagcacatcagtctgaacccccctcgatgcaccattgcaatgcgggcaattaacaattatcgatggcgttgcaaaaaccaaaatacttttcttcgtacaacttttgctaatgtagttaatgtttgtggtaaccaaagtatacgctgccctcataacagaactctcaacaattgtcatcggagtagattccgggtgcctttactccactgtgacctcataaatccaggtgcacagaatatttcaaactgcaggtatgcagacagaccaggaaggaggttctatgtagttgcatgtgacaacagagatccacgggattctccacggtatcctgtggttccagttcacctggataccaccatctaagctcctgtatcagcagtcctcatcatcactcatctgccaagctcctcaatcatagccaagatcccatccctccatgtactctgggtatcagcaactgtcctcatcagtctccataccccttcagctttcctgagctgaagtcccttgtgaaccctgcaataaactgctttgcaaattcatctggaagtgtctgtgtgtcttcctcggccgctctgctgtcatttagtgacaatctgctctagagatttgggtttatcatgaatctctccccctcaatatctgaccaaattccttgattcccccatcatccttcatgtgatacctgattccaggcctgccttaaaaaaaaatccaattgagtcaacttagcattggtctccctagccttaatatctcctctaagcaattttccat

SEQ ID NO: 2864 - DNA, 694 bp; single-stranded, linear
cacaggagctacagcgcggagactggaaacatggttccaaaactgttcacttcccaaatttgtctgcttcttctgttggggcttctggctgtggagggctcactccatgtcaaacctccacagtttacctgggctcaatggtttgaaacccagcacatcaatatgacctcccagcaatgcaccaatgcaatgcaggtcattaacaattatcaacggcgatgcaaaaaccaaaatactttccttcttacaacttttgctaacgtagttaatgtttgtggtaacccaaatatgacctgtcctagtaacaaaactcgcaaaaattgtcaccacagtggaagccaggtgcctttaatccactgtaacctcacaactccaagtccacagaatatttcaaactgcaggtatgcgcagacaccagcaaacatgttctatatagttgcatgtgacaacagagatcaacgacgagaccctccacagtatccggtggttccagttcacctggatagaatcatctaagctcctgtatcagcactcctcatcatcactcatctgccaagctcctcaatcatagccaagatcccatctctccatatactttgggtatcagcatctgtcctcatcagtctccataccccttcagctttcctgagctgaagtgccttgtgaaccctgcaataaactgctttgcaaattc

SEQ ID NO: 2865 - DNA, 1489 bp; single-stranded, linear
ctgcaggcagcatatagttttcatccagagtttggatctaaccagcaaaactctgtcttacacaggatgacttggaattagagtccttatagcagaaagagcagcagggctgtccttgggtatccgttgctcagccaagtcatcaaataaaaaggatgattgcacaagtggactatgtaccaatctgtgggtttctgcatggccaagagccagaccctccctctgggctctgctggcccaacccaccaagggatgctttatttaaacagttccaagtaggggagaccagctgcccctgaaccccagaacaaccagctggatcagttctcacaggagctacagcgcggagactgggtaagtcaacgatccccagagctgggacagaaggggcagcaatggggcagcaactgagggagaagagagctgacgttagtgcttaggagacgttgcacactttgcagacaggaagtaaaggaaatgggaccccagagtggccgcagaggggcctgtggggtaagacactacagtgtgtgtcataaccaagacccgatcagggagtagttacttctcttcttttcttacaggaaacatggttccaaaactgttcacttcccaaatttgtctgcttcttctgttggggcttctggctgtggagggctcactccatgtcaaacctccacagtttacctgggctcaatggtttgaaacccagcacatcaatatgacctcccagcaatgcaccaatgcaatgcaggtcattaacaattatcaacggcgatgcaaaaaccaaaatactttccttcttacaacttttgctaacgtagttaatgtttgtggtaacccaaatatgacctgtcctagtaacaaaactcgcaaaaattgtcaccacagtggaagccaggtgcctttaatccactgtaacctcacaactccaagtccacagaatatttcaaactgcaggtatgcgcagacaccagcaaacatgttctatatagttgcatgtgacaacagagatcaacgacgagaccctccacagtatccggtggttccagttcacctggatagaatcatctaagctcctgtatcagcactcctcatcatcactcatctgccaagctcctcaatcatagccaagatcccatctctccatatactttgggtatcagcatctgtcctcatcagtctccataccccttcagctttcctgagctgaagtgccttgtgaaccctgcaataaactgctttgcaaattcatctgaaagtgtctgtgtgtcttcattagccgctctgctgtcatttagtgacaatctactctagagatttttcttcctctaacctgagacttccgggaaacagagagatttgaagataagagacgctttctgtcatgaaacagcacagtcttatccctctccctgctttaggctgagaagctgaggtctcaaccgatatctagcaactgtcgaagactcttgctttgatcaagctt

SEQ ID NO: 2866 - DNA, 735 bp; single-stranded, linear
gctgcccctgaaccccagaacaaccagctggatcagttctcacaggagctacaggccggagactgggaaacatggttccaaaactgttcacttcccaaatttgtctgcttcttctgttggggcttctggctgtggagggctcactccatgtcaaacctccacagtttacctgggctcaatggtttgaaacccagcacatcaatatgacctcccagcaatgcaccaatgcaatgcaggtcattaacaattatcaacggcgatgcaaaaaccaaaatactttccttcttacaacttttgctaacgtagttaatgtttgtggtaacccaaatatgacctgtcctagtaacaaaactcgcaaaaattgtcaccacagtggaagccaggtgcctttaatccactgtaacctcacaactccaagtccacagaatatttcaaactgcaggtatgcgcagacaccagcaaacatgttctatatagttgcatgtgacaacagagatcaacgacgagaccctccacagtatccggtggttccagttcacctggatagaatcatctaagctcctgtatcagcactcctcatcatcactcatctgccaagctcctcaatcatagccaagatcccatctctccatatactttgggtatcagcatctgtcctcatcagtctccataccccttcagctttcctgagctgaagtgccttgtgaaccctgcaataaactgctttgcaaattc

SEQ ID NO: 2867 - DNA, 2918 bp; single-stranded, linear
cacaggagctacagcgcggagactggaaacatggttccaaaactgttcacttcccaaatttgtctgcttcttctgttggggcttctggctgtggagggctcactccatgtcaaacctccacagtttacctgggctcaatggtttgaaacccagcacatcaatatgacctcccagcaatgcaccaatgcaatgcaggtcattaacaattatcaacggcgatgcaaaaaccaaaatactttccttcttacaacttttgctaacgtagttaatgtttgtggtaacccaaatatgacctgtcctagtaacaaaactcgcaaaaattgtcaccacagtggaagccaggtgcctttaatccactgtaacctcacaactccaagtccacagaatatttcaaactgcaggtatgcgcagacaccagcaaacatgttctatatagttgcatgtgacaacagagatcaacgacgagaccctccacagtatccggtggttccagttcacctggatagaatcatctaagctcctgtatcagcactcctcatcatcactcatctgccaagctcctcaatcatagccaagatcccatctctccatatactttgggtatcagcatctgtcctcatcagtctccataccccttcagctttcctgagctgaagtgccttgtgaaccctgcaataaactgctttgcaaattcctgcaggcagcatatagttttcatccagagtttggatctaaccagcaaaactctgtcttacacaggatgacttggaattagagtccttatagcagaaagagcagcagggctgtccttgggtatccgttgctcagccaagtcatcaaataaaaaggatgattgcacaagtggactatgtaccaatctgtgggtttctgcatggccaagagccagaccctccctctgggctctgctggcccaacccaccaagggatgctttatttaaacagttccaagtaggggagaccagctgcccctgaaccccagaacaaccagctggatcagttctcacaggagctacagcgcggagactgggtaagtcaacgatccccagagctgggacagaaggggcagcaatggggcagcaactgagggagaagagagctgacgttagtgcttaggagacgttgcacactttgcagacaggaagtaaaggaaatgggaccccagagtggccgcagaggggcctgtggggtaagacactacagtgtgtgtcataaccaagacccgatcagggagtagttacttctcttcttttcttacaggaaacatggttccaaaactgttcacttcccaaatttgtctgcttcttctgttggggcttctggctgtggagggctcactccatgtcaaacctccacagtttacctgggctcaatggtttgaaacccagcacatcaatatgacctcccagcaatgcaccaatgcaatgcaggtcattaacaattatcaacggcgatgcaaaaaccaaaatactttccttcttacaacttttgctaacgtagttaatgtttgtggtaacccaaatatgacctgtcctagtaacaaaactcgcaaaaattgtcaccacagtggaagccaggtgcctttaatccactgtaacctcacaactccaagtccacagaatatttcaaactgcaggtatgcgcagacaccagcaaacatgttctatatagttgcatgtgacaacagagatcaacgacgagaccctccacagtatccggtggttccagttcacctggatagaatcatctaagctcctgtatcagcactcctcatcatcactcatctgccaagctcctcaatcatagccaagatcccatctctccatatactttgggtatcagcatctgtcctcatcagtctccataccccttcagctttcctgagctgaagtgccttgtgaaccctgcaataaactgctttgcaaattcatctgaaagtgtctgtgtgtcttcattagccgctctgctgtcatttagtgacaatctactctagagatttttcttcctctaacctgagacttccgggaaacagagagatttgaagataagagacgctttctgtcatgaaacagcacagtcttatccctctccctgctttaggctgagaagctgaggtctcaaccgatatctagcaactgtcgaagactcttgctttgatcaagcttgctgcccctgaaccccagaacaaccagctggatcagttctcacaggagctacaggccggagactgggaaacatggttccaaaactgttcacttcccaaatttgtctgcttcttctgttggggcttctggctgtggagggctcactccatgtcaaacctccacagtttacctgggctcaatggtttgaaacccagcacatcaatatgacctcccagcaatgcaccaatgcaatgcaggtcattaacaattatcaacggcgatgcaaaaaccaaaatactttccttcttacaacttttgctaacgtagttaatgtttgtggtaacccaaatatgacctgtcctagtaacaaaactcgcaaaaattgtcaccacagtggaagccaggtgcctttaatccactgtaacctcacaactccaagtccacagaatatttcaaactgcaggtatgcgcagacaccagcaaacatgttctatatagttgcatgtgacaacagagatcaacgacgagaccctccacagtatccggtggttccagttcacctggatagaatcatctaagctcctgtatcagcactcctcatcatcactcatctgccaagctcctcaatcatagccaagatcccatctctccatatactttgggtatcagcatctgtcctcatcagtctccataccccttcagctttcctgagctgaagtgccttgtgaaccctgcaataaactgctttgcaaattc

SEQ ID NO: 2868 - DNA, 391 bp; single-stranded, linear
ccatggaggaaggtcaatattcaggtaggaggactctctggttctaacgttggcagaagcaatgacccttagctactcctttcacccagaagagaagcggggcttcccagtccctctctgggaaagagggtgaatttctaagaaagggactggtgtgagtaaggaggtgaggccgcactgactttcctggcacagagccaggaaggagtggaaaattgagggcccctcctttttctgattcaacaccctcctgacaaaaaaagaaaaagaaaaaaaaaaacggcttcagctagggagcggggacgcaatagagtcagaggccaaatagaacaggaacttggaacaagcagaatttagcataatgaatcctccaagccagggtgagtgcaga

SEQ ID NO: 2869 - DNA, 3108 bp; single-stranded, linear
aagcttgggaataagtccagctgggccatgttgtgaggacatggggatgaagtcttagttccaggatggggctgggatggagtttggtgtttcttttctgtttttctttcttttttcttttcttttttttttttgtgagacagagtttagcttttgttgcccaggctggaatgcaatggcggatctcggctcaccgcaacctctgcctcccggattcaagcgattctcctgcctcagcctcccgagtagctaggattacaggtgcccaccaccatgcccagctaattttttttttttttttttttttttgtattttcagtagatacagggtttcaccatgttggccttgaactcctgacctcagatgatccacctgcctcggcctcccaaagtgctgggattacaggcgctgacgatgtgcccggtctctctctctctctttctctctctctttctttcatctcactgtgttgccccaggctgatcttgaactcctgggctcaagtgatccactcacctctgcctccccagtagctgggatcacaggcatgcaccaccatgccctgctagtttttatagtttttgtagagacaacggcttgctatgttgtccaggctggtcttgaactcccaggcttaagtgatcctcccacctcagcctcccaaagtgctgggattacaggcgtgaacgtccgtgccagccaaactgtccatatttgacctgaatattatctcacgtatctttctttccccccgcttccctccttccctcctactcctccttctccctctccttccttctgtcttttttttccccttcctctgcctctctctcctcttcccttttttcttgctgggactcaaacctgggacatttgacctgggagcctatttgctcaatcatcaagagacataatctcatggtggggtgtctgctggtaagtgccgggtggcaggatcccaactccaggccgtccttctaacccaagaggccctgcctctgcctagagccttccgtggctccccagggccctctgtgatcggccatagtggtatgattcagtgtgcagtaacagtggttcacatcttgacgctaccactcacctccttcagccctgtgggaacttgctgcttaacatctctagttctcacccaattctcttacctgagaaatggagataataataacacggacttcacccgggtgtggggagcaccaggagaggccatgcgtgtaatgttatccgggtggcaagcccatatttaggtctatgaaaatagaagctgtcagtggctctactttcagaagaaagtgtctctcttcctgcttaaacctctgtctctgacggtccctgccaatcgctctggtcgaccccaacacactaggaggacagacacaggctccaaactccactaagtgagtacgtatctggtgtgttgggggttggcccatgggcagtggagatcaaagcgcccttggaagaaacgaccttgggctgagcctcaagggatgaccagcaggaggtcacaaccagagaagggaggtggtgggtggtgagggggcgggggtgggggccgcagtgtggacagaatctcgaggcattcgagtccctgatttggggaagtgaaagcaggccatctggtctgagatgagcttggtgagtgcgctgggccgatcatagagggccctggggagccatggaagactctaggcagaggcaggacctcttgggttagaaggacggcctggagttgggatcctgccacccagcacttaccagtagacaccccaccatgagattatgtctccagatgattgagcaaatgggctcccagctcaagggtcccgggtttgagtccagtcccaccactgcgtgatggggacaaatgacttaccctcttggaacctcagttccactgagagaggccccacagaatgaggacagtcccccagcatcctgccagtaggtttactgagcacctactgtgtgctggtgctttgaatactcccaatttacagatgagcaaactgagctgctcatccagggagaagccaggactcggactcaggtctgtccagctgcctccctggacagttccagtcccaggatggtctctgggttcctctcacaatgtcaaaagggccagcttgagctgccgctaatcagagcctggccgcgccacaccccacctccctgaggctccgagagaagggacttacctatagtcaagcagcgaaagaaggtagcccgtgacctccaggcctgaaggaccccaagtcccatgctcctcagcacatagtagatgctttaaagtcagaggacttggtcgggcgcaggcacgcctgtaatcctagcactttgggaggctgaggagggcagatcacctgtggtcaggagttcgagaccagcctgatcaatatggtgaaaccctgtctctactaaaatacaaaaattagccaggtgtggtggtgggtgcctgtagtcccagctacttgggaggctaagacaggagaatcgcttgaacccgggaggtggaggttgcagtgagccaagatggtgccattgcactctagcctgggtgacagagcgagactccatctcaaaaaataaaaaaataggccatgcacaggctcacgcctgtaatcccagcactttgggaggccgaggcgggcggatcatgaggtcaggagtttgagactagcctggccaacatagtgaaaacccgtctctactaaaaatacaaaaattatctggtcatggtggcacgtgactatagtcccagctactcgggaggctgaggcgggagaatcgcttgaacccaggaggtggaggtggcagtgagccgagatcgtgcccctgcactccagcctgggcaacagagcgagactccatttcaataaataaataaataaataaagtcagagcactttacagatgccctggggacattggcagaggagaaggctgaggcctgggttatgggctcttagcatttctcagtgggacgtggcacagagtagatgtttcataaatgtttagaatctgaagacccactgtgcgcagcccggcaccaaaaacctcaggtatgctgtgatctcattggatcc

SEQ ID NO: 2870 - DNA, 1503 bp; single-stranded, linear
ctcctgcttaaacctctgtctctgacggtccctgccaatcgctctggtcgaccccaacacactaggaggacagacacaggctccaaactccactaagtgaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggagagtttatctgggtggatgggagccatgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctccc

SEQ ID NO: 2871 - DNA, 1530 bp; single-stranded, linear
agtggctctactttcagaagaaagtgtctctcttcctgcttaaacctctgtctctgacggtccctgccaatcgctctggtcgaccccaacacactaggaggacagacacaggctccaaactccactaaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggagagtttatctgggtggatgggagccatgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctcc

SEQ ID NO: 2872 - DNA, 6532 bp; single-stranded, linear
ccatggaggaaggtcaatattcaggtaggaggactctctggttctaacgttggcagaagcaatgacccttagctactcctttcacccagaagagaagcggggcttcccagtccctctctgggaaagagggtgaatttctaagaaagggactggtgtgagtaaggaggtgaggccgcactgactttcctggcacagagccaggaaggagtggaaaattgagggcccctcctttttctgattcaacaccctcctgacaaaaaaagaaaaagaaaaaaaaaaacggcttcagctagggagcggggacgcaatagagtcagaggccaaatagaacaggaacttggaacaagcagaatttagcataatgaatcctccaagccagggtgagtgcagaaagcttgggaataagtccagctgggccatgttgtgaggacatggggatgaagtcttagttccaggatggggctgggatggagtttggtgtttcttttctgtttttctttcttttttcttttcttttttttttttgtgagacagagtttagcttttgttgcccaggctggaatgcaatggcggatctcggctcaccgcaacctctgcctcccggattcaagcgattctcctgcctcagcctcccgagtagctaggattacaggtgcccaccaccatgcccagctaattttttttttttttttttttttttgtattttcagtagatacagggtttcaccatgttggccttgaactcctgacctcagatgatccacctgcctcggcctcccaaagtgctgggattacaggcgctgacgatgtgcccggtctctctctctctctttctctctctctttctttcatctcactgtgttgccccaggctgatcttgaactcctgggctcaagtgatccactcacctctgcctccccagtagctgggatcacaggcatgcaccaccatgccctgctagtttttatagtttttgtagagacaacggcttgctatgttgtccaggctggtcttgaactcccaggcttaagtgatcctcccacctcagcctcccaaagtgctgggattacaggcgtgaacgtccgtgccagccaaactgtccatatttgacctgaatattatctcacgtatctttctttccccccgcttccctccttccctcctactcctccttctccctctccttccttctgtcttttttttccccttcctctgcctctctctcctcttcccttttttcttgctgggactcaaacctgggacatttgacctgggagcctatttgctcaatcatcaagagacataatctcatggtggggtgtctgctggtaagtgccgggtggcaggatcccaactccaggccgtccttctaacccaagaggccctgcctctgcctagagccttccgtggctccccagggccctctgtgatcggccatagtggtatgattcagtgtgcagtaacagtggttcacatcttgacgctaccactcacctccttcagccctgtgggaacttgctgcttaacatctctagttctcacccaattctcttacctgagaaatggagataataataacacggacttcacccgggtgtggggagcaccaggagaggccatgcgtgtaatgttatccgggtggcaagcccatatttaggtctatgaaaatagaagctgtcagtggctctactttcagaagaaagtgtctctcttcctgcttaaacctctgtctctgacggtccctgccaatcgctctggtcgaccccaacacactaggaggacagacacaggctccaaactccactaagtgagtacgtatctggtgtgttgggggttggcccatgggcagtggagatcaaagcgcccttggaagaaacgaccttgggctgagcctcaagggatgaccagcaggaggtcacaaccagagaagggaggtggtgggtggtgagggggcgggggtgggggccgcagtgtggacagaatctcgaggcattcgagtccctgatttggggaagtgaaagcaggccatctggtctgagatgagcttggtgagtgcgctgggccgatcatagagggccctggggagccatggaagactctaggcagaggcaggacctcttgggttagaaggacggcctggagttgggatcctgccacccagcacttaccagtagacaccccaccatgagattatgtctccagatgattgagcaaatgggctcccagctcaagggtcccgggtttgagtccagtcccaccactgcgtgatggggacaaatgacttaccctcttggaacctcagttccactgagagaggccccacagaatgaggacagtcccccagcatcctgccagtaggtttactgagcacctactgtgtgctggtgctttgaatactcccaatttacagatgagcaaactgagctgctcatccagggagaagccaggactcggactcaggtctgtccagctgcctccctggacagttccagtcccaggatggtctctgggttcctctcacaatgtcaaaagggccagcttgagctgccgctaatcagagcctggccgcgccacaccccacctccctgaggctccgagagaagggacttacctatagtcaagcagcgaaagaaggtagcccgtgacctccaggcctgaaggaccccaagtcccatgctcctcagcacatagtagatgctttaaagtcagaggacttggtcgggcgcaggcacgcctgtaatcctagcactttgggaggctgaggagggcagatcacctgtggtcaggagttcgagaccagcctgatcaatatggtgaaaccctgtctctactaaaatacaaaaattagccaggtgtggtggtgggtgcctgtagtcccagctacttgggaggctaagacaggagaatcgcttgaacccgggaggtggaggttgcagtgagccaagatggtgccattgcactctagcctgggtgacagagcgagactccatctcaaaaaataaaaaaataggccatgcacaggctcacgcctgtaatcccagcactttgggaggccgaggcgggcggatcatgaggtcaggagtttgagactagcctggccaacatagtgaaaacccgtctctactaaaaatacaaaaattatctggtcatggtggcacgtgactatagtcccagctactcgggaggctgaggcgggagaatcgcttgaacccaggaggtggaggtggcagtgagccgagatcgtgcccctgcactccagcctgggcaacagagcgagactccatttcaataaataaataaataaataaagtcagagcactttacagatgccctggggacattggcagaggagaaggctgaggcctgggttatgggctcttagcatttctcagtgggacgtggcacagagtagatgtttcataaatgtttagaatctgaagacccactgtgcgcagcccggcaccaaaaacctcaggtatgctgtgatctcattggatccctcctgcttaaacctctgtctctgacggtccctgccaatcgctctggtcgaccccaacacactaggaggacagacacaggctccaaactccactaagtgaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggagagtttatctgggtggatgggagccatgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctcccagtggctctactttcagaagaaagtgtctctcttcctgcttaaacctctgtctctgacggtccctgccaatcgctctggtcgaccccaacacactaggaggacagacacaggctccaaactccactaaccagagctgtgattgtgcccgctgagtggactgcgttgtcagggagtgagtgctccatcatcgggagaatccaagcaggaccgccatggaggaaggtcaatattcagagatcgaggagcttcccaggaggcggtgttgcaggcgtgggactcagatcgtgctgctggggctggtgaccgccgctctgtgggctgggctgctgactctgcttctcctgtggcactgggacaccacacagagtctaaaacagctggaagagagggctgcccggaacgtctctcaagtttccaagaacttggaaagccaccacggtgaccagatggcgcagaaatcccagtccacgcagatttcacaggaactggaggaacttcgagctgaacagcagagattgaaatctcaggacttggagctgtcctggaacctgaacgggcttcaagcagatctgagcagcttcaagtcccaggaattgaacgagaggaacgaagcttcagatttgctggaaagactccgggaggaggtgacaaagctaaggatggagttgcaggtgtccagcggctttgtgtgcaacacgtgccctgaaaagtggatcaatttccaacggaagtgctactacttcggcaagggcaccaagcagtgggtccacgcccggtatgcctgtgacgacatggaagggcagctggtcagcatccacagcccggaggagcaggacttcctgaccaagcatgccagccacaccggctcctggattggccttcggaacttggacctgaagggagagtttatctgggtggatgggagccatgtggactacagcaactgggctccaggggagcccaccagccggagccagggcgaggactgcgtgatgatgcggggctccggtcgctggaacgacgccttctgcgaccgtaagctgggcgcctgggtgtgcgaccggctggccacatgcacgccgccagccagcgaaggttccgcggagtccatgggacctgattcaagaccagaccctgacggccgcctgcccaccccctctgcccctctccactcttgagcatggatacagccaggcccagagcaagaccctgaagacccccaaccacggcctaaaagcctctttgtggctgaaaggtccctgtgacattttctgccacccaaacggaggcagctgacacatctcccgctcctctatggcccctgccttcccaggagtacaccccaacagcaccctctccagatgggagtgcccccaacagcaccctctccagatgagagtacaccccaacagcaccctctccagatgcagccccatctcctcagcaccccaggacctgagtatccccagctcaggtggtgagtcctcctgtccagcctgcatcaataaaatggggcagtgatggcctcc

SEQ ID NO: 2873 - DNA, 825 bp; single-stranded, linear
gtaagtatcttccctctgtggctaggaagacaaggaatacatttttaaatgtctcctaaagcaaggacctgaaaccagctctatgggattattcttgttcctctttggtcaatgcagagacatgggaagaaccaccaaaggtcatgagggtctcttccagggatccctggacattgcctttcccagtggtgtgacaagagttagaggtggcctaccttgcctcctgtcctaggaggcgacagtaggagagccttcggttttctcatcctcttacttgtatgttgaactttacttaatgcaggctatatccaaaatacagtgtgaattaggctagaatagaaatgctttctattctaccttcagaaaaggaaaagggtagggtaggggaaatcatgggagagattaaaggcagagaggaaacccagatgggactgtttaatccccaagcaagaaaccactaggaaagagagataccttccctctaacttttgtattcggtgcactgacattgctctctgtgctggtgggaaattgatttctgtgccaggatgttctaggctgaggccaagagggtgctggccctttacccagtggaagaaaaaggcaagggtgaggctttgtagactttcccattcggaggtaatgatgcctccttcagccccacttcttcaaactgactccacctgctcccatctccacacccctccgtttctcatttagccaaagcacatcatccttgcagcccaccactcagcttggccaggtgcgagacatctttccccacttcatacctcccctccggccaggtgatgtttgcctcctcag

SEQ ID NO: 2874 - DNA, 32351 bp; single-stranded, linear
gatcacctgaagtcaggagttcgagaccagcctgaccaacatggagaaaccccgtctctactaaaaatacaaaattagttgggcatggtcgtgcatgcctgtaatcccagctactcaggaggctgaggcaggagtatcacttgaacccaggagacggaggttgcggtgagccaagaacatgccattgcactccagccttggcaacaagagcaaaactccgtctcaaagaaaaaaaaaatttttttttgtcaacccatgtgggtatgaaattgtttctcattatttgcatttcactaattactagtgaggtcaaacattttttccctcatttcttatccattaaagtttattctgtgaattgccagttcatggccattttgggggtgtagtttttcttactgatttattgaagtttaatgtttttctggaaactaatattttgctagttgtgtgaattgtaaatatcttctcccactgtatttttttaaaaactttttattgtctgaattagcacatatttagtgaatgcctctatgtgcaattctttttttttttttttttttttttttgagatggagtttcgctcttgtttcccagactggagtgcagtggcatgatctaagctcactgcaaccttcacctcccgggttcaagtgattctcctgcctcaggcctcctgagtagctgggattacaggtgcccgctaccatgaccagctaattttttgtatttttagtagagacggggtttcatcatgttggccaggttggtctcgaactcctgacctcaggtgatccacccgcctcggccttccaaagtgtagggattacaggcatgagccagtgagctcagcctctatgtgcaattcttaatgtcaagctgagggagaagtctaagaagttttatataagtctgacacccagggtgcctgtaattaaaggtggaatgaaattttaatttgcgagttgatccttctgttttttagttcagtacttcctcctttttagaatgtatgctttccagataattagtgagataaagatttgattttcacttttagcatttctaaaagctgtaatatgctacctaacttgtttttaattcttgctctaacttctgatattttatagttgtgtattttgaattatattttaaaggattaagtggattattgcacatgatatttagtaaagtgtttgggagcatttagcacagcctccaaaaattagaattccactagccccctgatcctacatatctggcatcttaagagtcaataatagcaaagttgagagaggcagcttggtgtggtggaaagaacatgggtattggatccgatagccttaggttcaaatcctggcttcttcagtaattatcttctgtaattttagccaagtgtttaatttccttgagactcagtttctcgaagatgaagtagaaaatggctttcaccaggttgttgtaaagactgaatcaaatagtgtgcatgaaaattgcaaggcatagtgctcaggacatagttaacattcttaaatatatgttgaggaatggtgtgcacctgaaaattcctataaaagctgcaaatatacatgccttttgatccagctgttccacttcaggatatccttactcatgtgtgcaaagcaattttttgtagaaatgtttgtaatagcaaaagactggaaacaactgaaatgtacactgctagggaactgattactctctggtatgtccacgcaatgcagctctatgaaaaaaaggagtacgtgtcaagatatattaacaaataaagtacagaatattgtactgtacttatcccttttgtgtttaacaaaagaaagaaaaggagaaaaattagaatatagtatatatttgcctttatgtgcaaaaaaaggaaatcactttttgttttttttgagacagggtctcattctgtcacccaggctggggtgcagtggcgctatcacggctcactgcaacctcaacctcccaggctcaagcgatcctcccgccacagcctcccaagtagctgggactacaggcacacgcgccatgcccagctaatttatttatttatttttggtagagatggggtttcgcgatgttacccaggctggtctcaaactcctgagttcaggtgatccacctgtcttggcctcccaaagtgctctgggattacaggcatgagccactgtgcctgacctcttttcttcttgatgtgaaattcttcatagattagacaaatttgcccattgtgcaaatatgttgcaaatatattttctcagtttgtcatttatcttgatttttcttatggttttaaaaaaatgtgattggatttatggtttctggcattgaaccatagttataaatgtattctttactctgaggttgtccagggaatcttctaattttcttaatttaattttcatcttttaaaaacagctctattgatgcataattgatatacaaaaatagcatatatttactactatttgatgagtttggacatgtgtacacacccatgaagccatcagttaacctgatggtggtgatggtttcctgtaattttatgcttccatttttcacatttagatctgacttttctggaatttatctaagtgcacgatgtgaaagatagatacagcttatttttctttccagatggctataccttgttctaggacaatttattaaatagtccatctttttctttctgatctgagatgctatctttattatatgctaaatttctgtacatgtttaaatttatttgctccttttgtttgtctctttgtacaccagtatctacctcattgttctaattattcgagcttcaggatacattttaatacttctgggtaggaacagaaccttctcgttactcttacaaaattttcttctttattctggtttatttttcctaagaactttaaaagttggcactgaattccaaaatagaacacccaaaaacctgttgatttttccactgggattatgttaaattttcgggttaacttaggggaaaaccattatttcatgatgttaaatcttactccatgagagagcatggtacgtcttttcatctgtacaggtctttttttatattgttcagtagcaatttaaaaaaatcatccactatgttcaatgaaataaaaggccagatttaaaaatttggcaaggagttgaaaactataaaaaggaaccaaataaaaattctttttttgcccccataaggcagaagaaatacaaattctacaactgaaaaaatataatatctgatattaagaaatcaataaatggtttattatattagctacatttgaagagacaactaaaaaagaaaaatattttcaaaccaactcagaaacaagaagatggaaaataaagaatacaatgctatttatatttatatataatagtatatataatacacaagtttaacataggactgcatttgcagaatagaagagagataatggggagatagcaacacttggagaaaaaataacgaacacttttttatttaaagtgcctaacttggctgggtgtggtggctgacacctgtaatcccaacactttgggaggctgagatgggtggatcatttgagcccaggagttcaagaccaacttgggtaacatggcgaaaccccatctctacagaaaaactccaagaaataaaaaacaataatcatctgagtgtggtagcacatgcctgcgtccttgctactcaggaggtgggggtggcagaattaccagggcctggaagtcaaggctgcaatgagctgtgatcgcatcactatacttcagcctggttgacgagtgagaccctgtctcaacaaataaaaataaaaataaaaataaaaatgcctaacttggtgcttggcactttctaaaattgacacataatatttgtacctgtttatggagtatatgtgatattttgatacatgcatacaatgtgtgtaatgatcaaatcaggatatttaagatatccatcatctcaaacatttttctttgtgttcagaacattccaaatctagctattttgaaatatacaataaattattaactatagtcatcctaatgtgctattgaatattattgaattccatctaattatatgtttgtaccaattaaccaatctctacttattcctcacccccagctcccaccaaccctttccagtctctggtaactatcattttattctctacctccatgagatcaaattttttacctcccatatcgttgtcaatattattatttttcccaccctggctcctaatgaaggatttattgacaatatcactggaatctaaatcctctaggccattttttcaccaatgcccttattttcttagggcttttttttttcttaaatcaacagttttaatgagatataattcccattctataaaatttcctcgtttgaagtgtacagtttaatagcttttagtatatccacagaagtgtgcaaccatcaccataataaattttaaaacattttcagcagggcgcagtggctcacgcctgtaatcccagctactcaggaggctgaggcaggagaattgcttgaacccaggaggcagaggtttcagtgagccgagattgcaccactgcaatccagcctgggccacagagtgagactccatctcaaaacaaaacaaaacaaagcaaaataaaacaaagcaaaataaaacaaaaccaaaacccaacaattttgaacattttcatcttaccaccctgccaaaaatccctgttctccttagccatcaatcttcagctccctacccacttctaaccatgaatctattttgtagatttgtctattctcgatatttcatatgaatgaaataatataatatatggttccttgtgactagtttctttcacttagtatgtttccaagttcatccatgttttggtatgtatcagtacttcattcctttttatcatggaataatattctgttgtattgatatactacgtttcattcattcatctgaacatttggattatttccatttttgtctattataataattctgctatgaacacccatgtatacgtttttgtgtggacatgatttcattttccttggatatacacctagcagtagaattgttgagtcataaagaactctaggtttagctttctggggagcttccagattattttccaaaatggctgtgccattttacattcccaccagtaaagtatgagggttctaatttttccctgtcttcaccaatacttgttgttatctatcttttttattatagtcatcatagtctgtatgaagtgatttctcactgtagttttttcagtagtaattaaaaaatttcctacctattttagcctaaaattactttcctgactctcttcaaggagcctgccagagaattctctctctcgtgctgtctcccttatgcctgggcataagctctgataatgccctgtctgggaaaactcttttggccttctcaatttctattacattgagagcccaagaacccatggtcagtaacaggccaatgagaagcctcctgcattagtctaggtgaaggataatggtggcttggaccggaatagggtggtagtcatggaaatggggagaatttgacagactagatttattttggaaatagaactgaatctgaacagattgaattgggcagggagcagggaaagtgaaggggaaggaagacaccaggtttatgccttcagcatttgggtggatgaatggatggatgaaaggatagatggatgcatggatggtggttggatggatgagtggttggatgaatggacggtcaaggggtgaatagatgggtggatggaaaatggagagatgatgaactgagatggggaagactagaagtggggcatatttttggggaaagacagttttgcaatacgttaagtttgaggtgcctcagagtcataagagaggatttgtcagaaaggcagttggatataagattttgaagctcaaaagacagggagggcctgatggtatgtttaaacctatacggatatcacataggtaacatttcaagcctaagaaatgggccgggcgcagtggctcacacctgtaatcccagcactttggaaggctgaggcgggtggatcacttgaggtcaggagttcgagacaaacccagccaacatggtgaaaccccatctctgctaaaaacacaaaaattagtggggcatggtggcacatacctgtaggcccagctactcaggaggttgaggtgggagaattgcttgaacccgggaggcagaggttgcagtgagccaagattgcgccactgcactccagcctgggcgacagagcaagactccgtctaaacaaaacaaaacaaaaaaagccttagaaatgggcaatgccaccaaagcagaaagatgaaaggagggcaatgccctgaggtgtgccagcattggaggaaacaaacagccagagatgtaggaggaaagcccagagaaactgtgagctgcaaggatgaagtagtaacaaataaaatgccaccaagagaaccagaaggacgactggaaacaaataaacaagaaagactattgcatttagcaacgtgaaaacgttggattactttttactcagaaatcaaaccccaaggatagtgtttcccctccctacggggtttctgcaggtccctttacacgcccccttctacttctttaagtgctaaaagtgattaatttggggtgatgttttaatttctattctttttggcttataactgtgttttttcattctttgcaacaacagatagtatgttgtaatagaaaaatccattgtggtcaatgataacttctgcctgttcctgggcacagggggcatcactattagtgcctgttcctccctccctactgctgataaggaaacaggggcaggaataatactaataatttgtgctactttttctgcatacccttggccttattctggtctactgagctgggagcttgtctgaggctggagctctattgtctgaatccaggggcagaaagaactgagggctcttttacggcatccacctggaggctgcctgcaggcttgggttgctaagtgcactgcttaatttagaagcgccttttatcctggctctcttgaccagtcaaagttgtggtcgctgttttctacaaggactggggaaagaaagggtggaattaattaaacctggaggaagggactttgaagggcggagctaaggtcaaagaaagaaccctttaaataaagggcccacactggctgccagggagtgcgcaggactggcaagagggaagccgggctgctccacgcctttcacgccttccacctcctgcgtgtccatctgtgagaaggagccagagcccaagggagatgatggagcctgaggagtacagagagagaggtgagcaacgggcatccctggccctcttccctgctgctactcctgcaggaacggctgctggtgggtggcccttagattgtggggtgacatttgatgggagcattagaattgccttctgagagttggcaccagcaacatttttttttctgcgaaaggaatgtgggatcagagtgtaaaacttttctcaaccactctttcattctccctctcatatacccactctcacatatgtccacactaccgtgccttgcttttcctccccactttcccacaaaattgaggatttggatccctgagccactagatgggaaaaggggattgttcatattctgaaatagaaaaaaattttctcaatattctgtaatcactgcaaatcctttctttcttaacattcattccttcatgtgtgaatctatcagcagtgttctttcatttagtcattcatttcataaatatttagtaggtgcctactctgtatcaggcaaaaccaagtggttatccagttctcaggcatggatctcccttagcaggaaagtaggtagttgcttaaaaaagaatcttgaatgtctatttctataatgttttatatcctcctactcactaattagtgtgcgttagcttattccattgctttcctaaggcactgtcagctgagagcaagttcctgtggatatttatcttctgagtggaacacaaatacatttagcactgttcctggatcagtggagggttaggtctagagctctcagatctctggtggggccctgctggagaagaaccaggatgtgagagggttgaaggggagcagaaggaagatagaatggtgtggaaatctacctttgtctcataagttttgtctggggttggttctgttcttaagaactttgcataagctgatgcagaggggagaaactgagtcccctctcctaggtaaaagcagcccagggagtactaaggaatggatgttgagacagacaaagagatatgtacacacacacacatgcacacacagcaacagaggcactgaagactgcaatctgaaagaataaataatttgcaatagtttcagagtgttcaacttgacttttttttccttccttactcatatgttcattcacttgatacatttttttttagcatctaaaaaatatcctaagcactgaggtgttgatggaggcagcaggagggagagaaagtcattaagatttggtgccacatttcccaggccagggcagggggcttggtctggatccatggttgtgctttagggattctgtgagcctcagaaattatacacaaagttctgtgtatatgtaagcctacagttttaatcagattcttgaattaagtcctcatatgagtccaaaaaagatgaataataactgattcaatggggatggtgaaaaaatagatttttttgtcctttatcggaactgggcatggaatctttctatctgtgctaacagatataactggtgggtgtgtgtgtaacaatttttggatacaaagagctatagagtttctattgaacctataaaatagttaatagatgttctgtttctgagaaggaaagaaaggtaggagagacaatcaaaattgaagtggataaaggaaggggaaagaaaatgaaacgtttcactttggcgctagagttttgtgctttggagattttcctttttgttcatttgctcacttagaaactccctccatcattcattcactccctcactctttttttaaattctgaagataaggtcgtgcaggggatcagatcctaccctcggcccatgaatctgtctctctcttttttttgagtccaggctggagtgcagtggcacgatctcggctcactgcaacctccgtctcccaggttcaagcgattctcctgcctcagcctcccaagtagctgggattacatgcgcctgccaccacgcccggctaattttttgtatttttagtagagaggggtttgaccatgttagtcaggatggtcttgatctcctgacctcgtgatccgcctgcctcagcctcccaaagtgctgggattacaggcatgagccactgtgcccggccaaatccatctccttctttaccaagtctcttggcccggacctgagagggatgggcacaaatcggtcaggcccagtcaggggatttcagcctgatttctctatgtcacttctagggagagagatggtggattacatctgccagtacctgagcactgtgcgggagagacgtgtgacgccagacgtgcagcctggctacctgcgagcccagctgcctgagagtgctcctgaggaccccgacagctgggacagcatctttggggacattgaacgaatcatcatgcctggggtgagacacagtgaccacaagggcagttctggatttcagggcacagaagggtgggtggtggcctggagaaagacctgctttgggtcagcttgggatgagaatgcatccttcagccacttggccaccaacaccccagcccatctgctaggcatgtggagggcaggactttgactggtattaggtttctttttctttttttttgcccagttgtgccatggcatgaggtttctgatgccagggcagggctggccagaacacctgcattccagagcacagcctggcagaagtgtggaagtctaatgggatgggtggagaagtgaacattttgtctgaggggaaaggacactgtgtatagtaagacaggggagaggaagctggtggtagtgcctggccctgacgacggagccagagactcttctgtacagtgtctgagaccacaccaaagagaaggaaggaagtggggaacacatcctggcaaggacacgctggtgaccaggttgcgttggcccaggaaactgagtgggccctggcaacccctcctgtcccctctgaggtctggtgattgagctgcttttcaagagcaagaagggactttccctgaatcattgatactttccatgatggagggtgcagcctgggatagtgctggtggggccaggaagctgatggaagctggctgatgcatgggcttgagctggagcctgccttgatgggtggtggacacccctgaccactggcggtgaggagctctgccatggtgctcatgctaaagtggcatcgactcccttcctgtggcggggctccctgccatgtgccagctctgtgctggccacatgacatgctatctaatttaatcttcccagtggccctgttttacagatgaggaaactgctgatgctcagagaagttaactgtcttgcccaaagtcacagaattagtacctggtagatccaggattttaccctagaccagtcttacttcacaggctgtgccgtttctcctaccccctgtcacctctactggtgggtgcctgaatgtgcctggctaagcctgggcccctagcattgcctgtctggctccacacccccacacaagctgtgtcttccctctccctgcttggggcatttgtgttctgaaccacacatgtttagaggctcttcctgaggccagcttgaggtttgccttcatcattcccaaagaacttttgacttcaatgtgacaaaaaggccaggcgcgggggctcacacctgtaatcccagcactttgggaggccaaggcaggtggatcacctgaggtcgggagttcaagaccagcctgaccaacatggagaaaccccgtctctactaaaaatacaaaattagctgggcatggtggcacatgcctgtaatcccagctacttgggaggctgaggtaggagaatcgcttgaacccgggaggcggaggttgcggtgagctgagatagcgccgttgcactccagcctgggcaacaagagcgaaactccatctcaaaaaaaaaaaaaagtgacaaaaatatgcctagaggcaggggtgggaaaatattcaaactcagaaagtgatggcaattttgacttttttttttttttttttttgaagcaatagagacaaggtcttgctatgttgcccaagctggtctccaactcctgggctcaagtgatcctcctgcctcggccttccaaagtgttgggatgagaggcctaagccactacgcctggccatgagggcaatttcatacaaagccactcatctctttgaccattcagcctatttcacaagcattttttgaaaatgtcaatatcagtaaggctttacggaggctagatcctgataagattatctcctggattttattctgtaaaatgtaatctgctgaggggctaactgtaatctgggagtgagactgaaagcaactgtcagaagaggtggaaatgagctgattcatttgatcaagaggaattccagcagttgctgtgggtatggtcggtgaggctcatttctggaaagaggtctgtttgtttttgataagggctcttctggctattttatcttatttatcttacaagaacagactattgtctcttgatagagctaggaggtagaagcccttctctggggtttccaaaatactgtcactaaggacagtgataatgatggtcaaatctctcaactcatctctcaggccacaccagcctctgagagctggcctgaaagcagttggccctttgcttactcattttgctcagtgcctcattgaaaactgaattagtttttctcttcctgccaccacctagaaaataagagaagaagaaaaactctctttcccctttaattccaaccctggttagacaatcctcatttacttttcatgagagagagagagcatccccacgggaaaagtcaggacaccaccctgctcgggtgtctgggcttctgcctcattgcggtcacctgtccctatggggtatgtgtgaccacagggatgtggcctctctctgtcagccccagttctcgcctgcaaaacagagataatgtgtaggtcctaccccatagggtcctgtgagaagtaagtaagagaaggcttggagagcaggagatgtggttattaccgatcatgactcttacatggtgaaaattggaggaagaggtttgattctctgagtcaagtcaggatatgtgatgtgtctgtcacccacatgattagtttaccgttaatgttagagcttaacatttcacacatttcttgcccacgcctccacccacacaacaaccctaggagacaggatttattttacgatgagaaactgaggttgagggaggtgcaggagaggctcctggtcttatggggtctgtactgtaaacactttttgagacctccttttgaaaaacaaaaaagaaggaggccggacacagtggtgcacgcctgtaatcccagcactttgggaggctgaggcgggtggatcatgaggtcaggagttcgagactagcctggccaacatagtgaaacactttctctattaaaaatacaaaaaattagccaggcatggtggtgggcacctgtaatcccagctacttgggaggctgaggcaggagaatctcttgaacctgggagccaggggttgcactgagccaagatggcgctgctgcactccagccctggtgacagtgcgagaatctgtctcaaaaaaaaaaaaaaaagaatgaatctcaaaagagacccacacaaatggtatgttggagcttaagttcattagcttcatggtaaatctacacggtcacacagctggttagggactgaggtgggatgggaacttgtgtccttggacttaattcttaggctccttatactatacacactgtccaggacaaggtccttgctcttgaaggactctaagtatgtgtggacagtaaagaacaggatgatgccctaagatgttatcaaatgagtcctcagtagagtgaaacatctagaattctagagttctatcgctcagggaagggatcgaagggagctgtgggagctgggggagagttcgaggaggaaatgaatatttagtagctttctaagaactggcaggttttggaaggtcatgtctttatagagagtgcctttctatcaggggacacagcattgctcaaagacataaatgcagaaaggaacagggcatgcttcagagcagtgagatgaggagagatgagataatccatgaggccgatgaaccaccagggctgcttctgagttctgatggggggcccttcctgcccactcagctcctccttacatccggttttgattgtgggctcagggcttagcctggaggtcggcctcccatacgcttggtctgggctctcctctctaccgtctcctttcctcactacattcccaatgtgatgcttaaggacagctttgaacccattcacccagaccctctgagttgcatgctcagggagctcagtgctccataaaacaaaaacaaaaggtgccttttgcaagaaactggatgaaacaagtagtctgcttttctggagctcacagtctgcccttccttttttttttttgagacggagtcttgctctgtcgcccaggctggagtgcagtggagcgatcttggctcactgcaagctcagcctcccgggttcacatcattctcctgcctcagcctcctgagtagctgggactacaggcttctgccaccccgcctggctaatttttttggtatttttagtagagatggggtttcaccatgttagccaggatggtctcaatctcttgatctcgtgatccacctgcctcggcctcccaaagtgctgggattataggcatgagccaccgcacccggcctgcccttccttttattgctgggcaggggcggcatgaggggtaagtactggggactaatgtgaataccacccagaatcccacaactgggttactgtagtgattttccttttgcatatttccttctggactttgcatatatgaaaaggctccactgatgatctagcataggacatgggccacattagtgacaagaacaccagtgaacaagtctgattttcatggagttatgtcacttatttctgcttaaaagtgtcagcccatctctagagtgacacttcaccttgccagagatggtctctggagaaagaaagcctgctggaaatgcctcctggtgccaactctgtgcatgctctgcctccaggtggtacattggcagagcccccatatgcacgcctactacccagccctcacctcttggccctccctgctaggagacatgctggctgatgccatcaactgcttgggattcacctgggtgagtagcaacggctgtaactactcgcaatggggaacgtagcagggagtggtatcctagggcagacatattttgtcttggtttctgaatatggctccacaataaatattaatgagggctatattctttaagcttacgctttattttaattttctcatcacatcctttaaccctatggaatcacgagtattgatcccattttgtaggtgaagaaatcgaggcttaagcaacttatctcccccagatcacacagctcatagagacacagataagacttggatacagatctggttattgccacagtttgtgaccttacctaagcaatttgatgcctattgagtcaccacttcctctgtgctcttgtatttgagtagctggagatatgtcctaagacttcccttaataaccccttaagcaccactcagctttaaatggtgccaaaagccttccagaacatctttttattttaagcctgaactcctatgggtgtgtgggtgggtgggcgggggtattcatatcttttctaggaaaacatccccctgggcatttgaggacttctcagctatgtattttagcgacttggagaaccaaatccaagccaaccatttctagggctgtttctccatagagccttggagaattcgcctcattgagggcagcatgaatccaaaaccccacattattttctcttttggttgacagagagtggaccaggagagaggcacgtggcctaacatgaccccttctccagaaatgttcccattgacaccatcaggggcagacatgtttctggagctcgtgggggcacctcagtgccctggggctgtgcagtttgaagttccttttcctttctcaggcatccagccctgcgtgtacagagctggagatgaacgtcatggactggttggcaaaaatgctgggacttccagagcacttcttgcaccaccaccccagcagccagggcggaggcgtcctgcaggtacctcccttggcaaagcttcacctagcttgggggctaagtagcgaaagacaagccaaaccctaacctggcaattctcccgttctccatggagtttcccccacattacccacaccgtcatcaccaacagcaccatcatcacagcttcacctctactcccacctcagcttctgcttcattcacatgtactgctacttcctttgaaagaaattaaagagccaacacatgatcacatttccagtatgacttgattcaggtttcttagtctataatctgacaattcctttttggtgtcccattttgtatctcacggtaaaaggggaaaggagaaggcaaggagaggacttctctttctctccctgctaggttcaggagatccccttgcagtgagagcaattaacagcataaactgattaacggtatcctctgaccctatcttctggatacttgtcaaattatggttcttcaaatatttctttttttcaagagtagtgccatggagtggagctttctgggtgcctcccatggaccacacacattgttaggtgcttttgcatctataaatccttgacgttcatgagggcttggttctaagacctttgagattcctcagattcttgaattctttttttaaataaaaatcgtggctggacatggtgactcaccctgtaatctcagcacattgagaggctgagacagatggatcacttagcccaggagttcaaaccagcctgggcaacatggtgaaactgatctctccaaacaaacaaaattagctgggtgtggtggcatgtgcctgtagacccagctacttgggatgctgaggtaggaggattgcttgagcccagaagattgaggctgcagtgggctatgattgtgccactgccctccagcctgggcgacagtgtaagaccttgtctcaaaaaataaaaaaattgccatgttgctctgagatgagaaccaggaagttcactaggtcctcttgctagctaagtgactccctctctcactgcagccttgcagcaagattaaaatctgaacctcggaagaaagacaaattgcagcatgttgtggacattttggattgtcagcaaatagttacaacttcagatatcatatttgggagaacatgctaaatgtctgcggtacatgatcttgcttttcatctgattatctcaggaaccctgcaggtgaatagtaccattccccaatgttttgagataagagcactgaagttcagagagattaaataatttgccctagcttacacagctgataagcagaagaacgaggattcaaactgatgcctgtctaaatccaaaccatgctttctcctgtatcgtcagccatgtgaacttgagttagtcccatcacctctctgagcatcactctcctcatcttagtgtgacaagaatcataattatctcaaagaggtgttgtgaggagcaagtagaatgccagaaagtgttttgtaaactatgaattgcaatacagatggaaggtgttgttaccattattattatttttaaaaacagggcctggttctgtctcccaggctggagtgcagtggagccatcatggctcactgcagcctccatctcctgggcccaagcaatcctccaacctcagcctcccacgtagctgggactacaggtgtgcaccactacacctggctttttgttttttgttttttttgtagagacagggtctcactatgttgtccaggctggtctcaaactcctggactcaagggatcctcccaaagtgctgggattacaggtgcgagccactgcacccagctgattattattattattatgctacatacttctttacataaatagctttctttttatggagtaactcccaggcacttaatatctgtgggatctggtccacaccactctccatgacagtgtctgccaggcatttttagcaggattctatcagctgtaggtcacttgaagatttcaagaagcaaagacatcaaagactgggtgaatgaatgataaggaaccataaagactcctgtgaagttcctgaggtggccccgaagatttccacaatcatggccagagcaaaatcctacccaacccttgtttggataatctatactcccatcctgggaagcagttaaagggatgctctccatttcatagacagaaaagagtcttctggaggggaaatgttagcccaaggtcacaagagctattgacaactaaatgggcccaagtcaccagcctctcacacaggccaggatcctctcttcctggggactcaaactccatatccatttgtgtaataagctgagagttcttcttttaaatatgttttacatggggagcaaacacatccaggagggacagaacattctctttttggtttctgtggcctctgtaatagagaggctggtattaggtgcaaacttattttagaaggcagaataggaatgaaagttggggagggacatgggcaccctgggcaggaggagctgtgtatttccttctgtgaatagctatgacacacacatacacaaacacatacacacacagagagagagagagagagagagagagagagagagagagaaaaaactagaaagcctggggaaatttggcaagagaatacagaaaggctgccatgataatccttttcccctgcagagcacggtcagtgaatccactttgattgccctgctggcagcaaggaagaacaaaatcctggaaatgaaaacgtctgagcccgatgctgatgagtcctgcctaaatgcccgactcgtggcctatgcctctgaccaggtgagttgcccgacgcaggacagcccttcgggttggtgcttggcttctggaatcttggtccttgagcaatttttttctagacgtgagtacgctggggttctgagcagctcagacatgggagcttgtctccagcaactgtagggaagacaagcttccaatgatcatatttggttcccgagtcttaggcttcagcagtttctggggggtgatcattccaggatgactctttgctgacaggtttctgtggcccttctaggctcactcctctgtggaaaaggctggtttgatttcccttgtgaagatgaaatttctgcctgtggatgacaacttctcactccgaggggaagctcttcagaaggccatcgaggaagacaagcagcggggcttggtgcccgtctttgtaagtcaggatatatgcctaagcttagaatgatagaacttggatgtgaggaaggaattttggcagaattcaggtaagtaacatgctgcacacaaaagcagaaaggtcctcccatacagtattttacacatcatgaggtgctatccataggtgtgttatggaataaattttgtgggtcataaccagcattaaaaagaaatatagtataaaatattagagtgcacacatatagccagagtatgtattgttttatgaaacttttttttcaaatacacacgtatacatgtactagattgttatataaaatgtgtttcttacgagccatggtaaaacacagtctgaaatatacactgttctggtgggatggatgggagtagatcacgtctgtggtgaaatctttctcaggccaaatgtgtcacacgagcccaccctcctgtgttaacttgccttaattttcccctaggtctgtgcaacactagggaccactggggtctgtgcatttgactgcctgtcagagctgggccccatctgtaagtatcttccctctgtggctaggaagacaaggaatacatttttaaatgtctcctaaagcaaggacctgaaaccagctctatgggattattcttgttcctctttggtcaatgcagagacatgggaagaaccaccaaaggtcatgagggtctcttccagggatccctggacattgcctttcccagtggtgtgacaagagttagaggtggcctaccttgcctcctgtcctaggaggcgacagtaggagagccttcggttttctcatcctcttacttgtatgttgaactttacttaatgcaggctatatccaaaatacagtgtgaattaggctagaatagaaatgctttctattctaccttcagaaaaggaaaagggtagggtaggggaaatcatgggagagattaaaggcagagaggaaacccagatgggactgtttaatccccaagcaagaaaccactaggaaagagagataccttccctctaacttttgtattcggtgcactgacattgctctctgtgctggtgggaaattgatttctgtgccaggatgttctaggctgaggccaagagggtgctggccctttacccagtggaagaaaaaggcaagggtgaggctttgtagactttcccattcggaggtaatgatgcctccttcagccccacttcttcaaactgactccacctgctcccatctccacacccctccgtttctcatttagccaaagcacatcatccttgcagcccaccactcagcttggccaggtgcgagacatctttccccacttcatacctcccctccggccaggtgatgtttgcctcctcaggtgcccgtgaggggctgtggctccacatcgatgctgcttatgcaggcactgccttcctgtgccccgagttccgggggtttctgaaggggattgagtatgccgactccttcacctttaatccttccaagtggatgatggtgcattttgactgtactgggttctggtgagtgtagcagcccagctccgagcacgcaggaacgccttgcctcctctggagagacctcagccactaatgcccatttggaaacccacagggtcaaggacaagtacaagctgcagcagaccttcagtgtgaatcccatctacctcaggcatgccaactcaggcgtggccaccgacttcatggtgagtggccagggacgggcagcctggtgggctcgggtggccagtgggaactgtaggcgtctgaccccccaaaatctgtacggtggctcccttcagaaggcagcacactatgagctcatctcataatactgccaatgcataccttggtttctaattgtgcctaagtatatagaatgaaacccagaaaatggttaaaaaccctagaaaatgagaccagcctttgaggcagtgtgcacatttcctgaatatttgtggcattttttaattcccagaaatgctcttcctaccacaggtggaccagttccttctgcctccatctcgggtcatcttttttgtttcttacccagcagcagggcagggtggagaatttccctggtggggaaagagctttcttgctgaaatcgcttttgtttttttgtccctgacagaggcgctgtggggcagctctgtggtagtgatgggctgcaggacttgtgtgaggttctggaagcctccaagcattcctgactttcccaactgactgcgcctcaactctctaactcactctctctctcttttcttttgttttctttctttctttctttctttttttttttctgagacagagtctcgctctgtcaaccaggctggagagcagtggcgcatcttggctcactgcaacctccgccttccaggttcaagcgattctcctgcctcagctttccaagtatctgggactacaggcgtgagccaccgcgcccagcaaacctcaactctcttgattccacatcctcagccagtattttgcctgagggaaacgagttcttaacaaattgactccgcagtttgaggatgagcccttcctttacttgtaggggagacagggatgtaaacgaatgtattacacataacctggccaacggaggcagcagagcagagtgggggcaagcttggtttggaattccattccagcagtggccctttgggaaactaactggacctctctgagccttgctttccttatctgtaaaatgagaatagtggcattgattcatagggtattgtgaagcttaaatgggaacacgtgtggatcacctagcaaaatagccgtgtggcaagtgctcaatatatggtaggcatagtatttctgaaagctcttctttgaagctgcagagatttgttaggacagtggttaggcatgtaggtgctaaagccagatggcatgtgttggagtcctggctttctgtttactaacttgtgtgacctcgggcaagtgacttaaactctgtgtccagatttcctcttgtgtcaaatgaggctgatgaccacagttctggcttcttaggcttgctgtgaggattatacaaattaatacactgaagtgctgagagcagtgtctgacccctgtaagcatccttccttgtgaagagatggttttatcttatcttcttggacaactgaagtgtcttgcccttttagtcttaaaataatagcttcgtcatcacttgattatactggctattctcccttggaccagtccacaccctctttagatatttgaagcttttggattagaattgcagcggtaagcctcacggcttactggtggtgacagaagaccctctagaggtaaagaaagaaagaaaaataatggttctttatctccactgctctttctggtaggttttcagagatttttaatgaaaaattaaaaaaattccagaacagcccaagggtcagatatctttagggataactgtaggtttgcttcctgagtgtgaattgatgcccattctcctatgagtgtatttgggtcatcataactgaggagcattatattcacccttgcccttttgaatttcatgttaccgtttaaattcatttaccacagtgcctcaggatcttcccggggttcattcctaggagtttggagattttacagtgctctctgtcttccagataactcataaaaatgttagagtaaactcttcccagccctgctctggggaaccttattatttttacctctccacccagaaggcactgccttacacttacccttcccccacctttaatcctatggatttgattttcaagtccatgaagaaactcctagaaaagtgaagttgctatctttttcatgatcctgagggtcctcagagctactctcacctgggcccaatgtctttcccacccaggtggctgcagctttgaacagaagctcagtcctgctctgagatgagccagaaacagggcagcatcccaggagagaagacttaggtgcttaacccctggggtcctggaatcacctaaaatcagggctagattctctgacagcggagaagctccctgttttctgcctctcactggacagagagcaccagtggagggagcgttaccttagccttggcaagggagccctgcaaggaccttacaaggacacagaggaggctggagatgcctcaaggtaaagaagagccctgtcaggctttatacgtccagattttttgatccaacagaaaatgttggctagaaccactctgctgagtcagcatggatcagttttggaatagtgacaagaaaaggagcaactgggaataaggaagattgtgaagaaatcaaaataaaatcacctctgcctatcctggtttatttgctggtaaaataaagtagctctctctatatatgaaataaattggctataactatctggaaaccagaaccttttgacagatgatccctatcatccgttcattattctcttggagtgtccattggacaagaggtggagttgacactttccttgttacagcaattttgttccattttcaggttttgatgccttctgctggcacaaaagcccccaagctgctccccagcacaacagagttttgcttggaaatcaaaggcttagtagttttctgctggggaaacattgtccatcaacaaaggggtaacatcccaactgtgcctggctcaggaaactggggtgaagggtgaaggtgaggacatttgtgaggatttgataatcttgtgtatgggcagataaatacgcagtgggacaaacatttatttttagtcaacagaaattgtggtagaaactttctgacgtttgagggagatgtcattaggaaaccacgtgactcattagaataactgtaaatgttttccaaatcctctgctctattttcagatctgagaaatcagtctgaaattgatttggaaattttcagatgtatggtgactgcaaccttgaactttaagctctgttgaatttggccaccaggagcaaagagtcaattttcatctaacagcggcagaaatttgggtgctcatttgaaatctgacagctggagtgatggctctcagatcacaggaatctcacaggaaaatgaacaaggcagtgtaaggttaaataggggtcatcttggctctagacagaaatgctactgtgatttgtagctcacattttaaaataatctaaatagccaacacctactgacaacttcttctgaggctcttggcgttctttgtcctcacaccacttgcccgggaggtgcaattggttctttatgtcccggactgatgagccagtgaggtggcactacccaaggtcacacagctagtaagtggcacagctggaggcgaaacctaggtctgcagggctctagtgtctgtgctctaactaccatactttacattttgggaggaataaaaatagaactttattttctgctattcaaggaatatagattcatttagagtaaaaatgtatttcccttatgttgagtttctgggccgggatgaaatgtttaaagcagcacttgaaagcaaagtgcccttctcattggttcagggtaatggacttgacttccacttgtctggctctcagacaagtgactattggccaccttcatcagtgatttggtcacacgatggggcaacccttggggagcttggcttactccttagcaacagctcccagagtcatggtgacatcgtccatccctggagggctgggcaggcaacagataatgcccagaaatgcccgagggagtggggcacccttgtctctaaccttgggcactgtgttcctttgtttctagcactggcagatccccctgagccgacggtttcgctctgttaaactctggttcgtgattcggtccttcggggtgaagaatcttcaagcacatgtcagacatgtatgtagcatgctgctgtgggggctgagcctgtgttcctctgttttctcatggcgaggaaggctggtttctactttgcagatctgcctaggagacttgcggtgtgtggttcaggtgtctgggcctgttcctcagctcctgggacttgattctctttgttaaccagaggagcgctgagcacaacatgccctgagggctgcctgatgcctgtcctctgctgagtgtctcaccgttccccttgctgtcactgagcactggggagggttggccccagagtctggtttgcaggaaagagaaagagaaagtaaatcaaggggaagtgtgtgtggccagggtaggatcctatctgctttggaattacctcaatggtcacagctggctgaatacttttagcactattatgattatgcctgaaataaagctcccctggccttggacaggtagacctaccaagtctggaacaaacctccctgcatcaacaggcatttattgaaggcctattttgcttaatttatttctattcaattcaacaattacaaggtattgtgctaagaaagggacacagaggtaaatgagacaggtgcagcctctctcccatgttcttcatggaagaagcgggacttaactaagaactctggccactggcattgttctcccacttctacaagagtccacatgcaagacaaagccattgataaaagtagtgggggaagctgaagacactgtcctttctgcctatgtgtgtctttgtccttccacctttcctctagggaattccttcttggttaaacaaacacaaaccaaaatgaagtggtggaagcggtaactatgattttttttaacatttaaaaaaaataattattatgcttacataataattacgtatatatttatggggtatgtgtgaggttttgatacaggcatacaatgtgcaatgatcaaattagggtaactgggtatccaccactcaaccatttatcatttctttgtgttagaaacattctagttccattctttaagttagtttgaaatgtacagcaaattatagttaactatagttgccttattgtgccgcctaacattagatctatttaattgtatttttgcgcccgttaactatcacctctttatcccccattccctgctacccttcccagcctctgccaaccatcattctactgtgcgtctccacgagctcagtttgcttactttttaactcccacgtttgagtgagaacatgtgaaatttgtccttctgtgcctggcttattttgcttaacataatgttctccagtttcctatgactggttttaatgttggtaattttacctttgtaatcaccactggttgtttaccaatgagcagctgccaccaacaatattgaggaactttaggcactttgtgctgtttctagaaatgcagactcaagactggagggttgtgggcggggaatggttggtggaggttacaagtaattaggaacatttttttgcttacagtttgggactggatattcaatgtgcagatcctgactaacctcccttagcacttctgtttgcaaatcaaacccctgaattcctcctattagcaaccccattgcctaccatatgaggcccacactcctgggcctggctttcaaggacttgacgattagctcctaccttagcttgggcatttcatcgacccatccagacctcatgctcagtccatctctgcaccttcacccgtgtccttcacctgaactaccctctcctctccaaatgttgtgaatggattaaattctgcttccactagaagcttttctgcctattccatctgttctggtttctgcttcattagcattcctgtgatcacctactcaaacacctttacaaaactgtgctcaaagttcttccaatgtcccacaatagaagaaatggaattaaaataaagttgtttgatatgatttgattttatctcttcaacttgacggtgatgataattattgacacttgcgtaatgccttcaatacaaaaataaattctagttcttcattagatccttagcacagtgcctggggtggtcactctaacctggcaaggctcagagggagtaattgccctgcttgagggaagaaggcccgggactttccctgaagcctcccaattccaaatcctttcttcatagttctgggctgctttctactacactgagctcttggaaagttatataaaattaaatttcatatttctgtgttacagagaagtgctttaaagaatggatttttagttctaccctttacctgtttgatgaccttagacaaattacttaacctttctatatttgtctgccttatttatttattgttatttatttttgagatgcaggtctctgcttgctcaggctgaagtgcggtagtgccatcagagctcactgcagccttgacctccccaggctcaggtgatcctcccacctcagcctcctgagtagctgggactacaggcgcataccatcatgcctggctactttttgtattttttgtagagatggggttttgtcatgttgcccaggttgttctcacgctcctgggctcaagcaatctgcctaccttggcctcccaaagtgcgaggattacaggcatgagccaccacccctggccatgccttcctaatttataaaaatgagaaaaggatactacctctctcaaattaaatgagataatatatatgcagcccttagcacagggtctacctactactcagttaagtactcaatgagtacctcttcctcttctcttcttccccttcttcatcatctccttcttcatctaattataataaattgtcatcatcatcaccatcatcatcatcatcatcctcatctcctatcacctacaatagggattggtaaacatttcctgtaaaaagccagatactaaatacttttggctttgtgggccatactctattgtaattacctctgtactacaagagctaccgtagacaatatgtaaacaaatgggaatgctgtgttccaaaaaactttacaaacacaggtgggggctatatttggccatggctgcactgtgcctgcccttgacctagagcggtgcagggcactggcagcagctctgctttcatgacctgtaaagtggggctttggaggtggcagtgctgcctgtgctctgtattctcctctcccctgacctctgcttctgttattgcaaacagcatgtgttgtaggagggataaaagcacagtgggaggagatctacctactgtcacttgtaccttgggaaagtcactttcccttggttccttctaaaaaatggaaagattgagctgggcacaggggcacgtgtctgtagtcccagctacttgggaggctgaggtgggaagctcaattgctcccaccatagcccaggtgggagttctgggctatggtgtgctatgccaattgagtgtccgcactaagttcggcatcaatatggtgacctcccaggagcaagggatcaccaggttgcctaaggaggggtgaaggggcccaggttagaaatggagcaggtcaaaactcctgtgctgtttgaaactgaccacgcaggggagaaaggggctctgagaaagatttggagaaactcatttcattatggtcaaaagacaggctcagggccagacatggtggctcatgccagtaatcccagtactttgggaggcctaggaaggaggatcgcttaagcccaggagtttgataccagggtgaacaacctagtgagaccactgtctttacaaaaaaattaaaaaatgtagctgggcatggtggtgcatgtctgtagtcctagctactcaggaggtgaaggtgggaggattacttgagctcaggagttcaaggctgcagtgagctttgattgtgcaacatgcctctgtactctagcctgtgtgacaaagcaagaccctatctctcaaaaaaaaaaaaaaaaaaaaaaaaaagaggttcagctaactcccttgccctctcttgaaatagagcagtaagtatgagaactaactgatagaattacttagcaaatatttttattgagatcttctggatgcttggagaaatttttaaaaagaaaagagaaggcaagtcctgtccttgtttagttagtaatcctgggttaaaaacaaaaagcaaaaaaccccaggacatttaaaaagatggtatgaacttcagtggaagattaatataatacaaagcctttaacattttaaaatgtaacaaaatattcataccatagaatgtaccattttactcatttttaagtgtacaattcagtggcattaagaatactcacaatgtggtgtgaccatcaccattatttccagaattttttcatcatcccgagcagaaactctgtatccattaaccaggtccaaaacctttccatgatgggtggagacaagatgtgaaaatatgttctctatggaatgtcagaaacaggggatgaaaagggcatttggggtacagggtgagaagaggtttgagaggcaagtgaagcatgtaggcttaggatggggcagggccgccactagcccatatggcaacttgatgtgcactacaaacaggcatctcttcctttaggcacacgcagctcgcatgaggcacctggctgggaacgcagagcatggactgggttttggccctcacttgcccacttggccagtcaaggagctgtgaaatcaggagttgaggccgggttgcctggactgcaaagcacatgccttctgggttctggggctgagttgaaagagggccctgagatgagttctcgaggtggatcccatgtgacaggaaacagggcgccattggaaattttccagcttggaatatgagcaaaatcaaatggagatgacaatgaggcagaagccgcttacaacggctgtgacgggaagatggccctggtttaaaaccatttagcagtctgaaagtttatgcatagtctcttgtctgatgattaatctcagttctctttatacttgcaattccagggtactgaaatggctaaatattttgaatctctggtcagaaacgacccttcctttgaaattcctgccaagaggcaccttggcctggtggtttttcgtctaaaggtaataccatcttccaagcccctctgtgaatgatgtcttgtggtgctccagagcctctcggaaacacaaactgggctctggggatgctgacagggggtgcgatggagacttcacttcctttatttttcaaacagggtcctaattgtctcacagaaaatgtgttaaaggaaatagctaaagctggccgtctcttcctcatcccggccactatccaggacaagttaatcatccgtttcactgtgacatcccagtttaccactagggatgacatcctgagagactggaatctcattcgagatgctgccactctcatcctgagtcagcactgtacttcccaacccagccctcgggttgggaacctcatctcccaaatcaggggtgccagagcctgggcctgtggaacgtcccttcagtctgtcagtggggcaggagatgatccagtccaggccaggaagatcatcaagcagcctcagcgtgtgggagccggtcccatgaaaagggaaaatggcctccatcttgaaaccctgctggacccagttgatgactgcttttcagaagaggccccagatgccaccaagcacaagctgtcctccttcctgttcagttacttgtctgtgcagactaagaagaagacggtgcgctccctcagttgcaacagtgtgccagtgagtgctcagaagccactgcccacagaggcctctgtgaagaatgggggctcctccagggtcagaatcttttccaggtttccagaagacatgatgatgctgaagaaaagtgccttcaaaaaactcatcaaattctacagcgtccccagctttcctgaatgcagctctcaatgtggactccagctgccctgttgccctctgcaggccatggtttagacacagggccttcagccagagtctgaggatatacttcagggactctgtgaacccctcacaattgtatgccaactttgtgtgcttatgtgtacatgcatttttcttggggcgagttcataattttaatcaaattctcataggggcttcatgacccacaataggatacaaacgaagagtttaagccagcatgatccagatgggttcagcagtctggtcagtgagaaagggccgagggtagacaggcagcttctgtggttcagcttgtgacatgatatataacacagaaataaattatgcttgtccctgaaacaaaacataccctgtgtcacttaattggctgctgaaacattgattaaccagtctgggagcttaaacatatgtactttttttgaagcatcaattatgagtcaggcactgtggctcatggttcataaatgaggaaaccaacgtttaggtcacacagctttaaataggcaaacccaggtctcctgcttccagtgaagcccaggctgtttccaccatgcagtactgctcaaggttggacctgaacaggagctcacagcccagcaggctgctggtcctccagtacatttaaatgtttcctttctaggtttggaacttgtgcattttccccttattttcctggacccggtagtcaaataaaagctatgctcacaagtggcttgcccataattagttcagaggccaaacacataattttatttccatttcagatggtactttgataggttgtgactctgaaatgggttatgtaaagagtattaaagacaaacaaagctgggcattagttagaactttaaggatagatgttaaacagtaatatactatcacaatagggaaaagggtcccatgtgaactgaactcaacttggatttgtgcaaaggtgactaggcatttcacagcgtgaatgggagaatagggagaaggccagcctagacttagaagagtcaggaatgtgaaaaattacaaaaagcggaaagtggttgatgtgaaacccctctgggtttgctaactggtgctttttgaagtaagactcttaccctcccacagagactgggagtcagggccctgtgttcaggggttcgctggaacaaacagttaattctttcggcagctttgagttttcttaagcaggcactttaaggtgagctaggatcaacttagggatgtggccttgagctgtgagaaactgtgttagtgtttgttcaagtctttataggcaaaggttgaggcctagttgagaagggggctcggaggagcttagctagagtttggtcgagaaaagaatctttgttaagagtttaaagcttttttttttttttttttttttttttttttgagactagtgctttctctctttcccaggctggagtgcagaggcacaatcatgtcttactgcagcctcaacttcctgggcttgagcaatcctcctgcttcagcctcccaagtagctatttatttttgagatggggtctcattctgtgagtgcagtggttggaacacagttcactgcagcctcagcctctgaggctcaagctgtctttccacctcagtcccacgagtagctgggactatgagtgcacaccactatgcctggctaatttttataactttttacagagacagggtctccctgtgttgcccaggctggtctggaactcctgggctcaggtgatc

SEQ ID NO: 2875 - DNA, 2371 bp; single-stranded, linear
cgactaagaagccctgttgacagctgccttccagcctcctctgtctgtctgccaggaggagcaatccaagggagatgatggagccctgtgaataccgtgaataccgtgaatactaccgagctagagggaaagagatggtggattacatctcccagtacctgagcactgtgcgggagaggcaggtgactccaaatgtgcagcctggatacctgcgagcccagctacctgcgagtgctcccgaggaacccgacagctgggacagcatctttggggacattgaacgagtcatcatgcctggggtggttcactggcagagcccccacatgcacgcctactatcctgctcttacctcatggccatccctgctaggagacatgctggccgatgccattaactgcttaggattcacgtgggcatctagcccagcttgcacagagctggagatgaacatcatggactggctggcgaagatgctggggctcccggagtacttcctgcaccaccatcccagcagccgagggggaggtgtcttacagagcactgtcagcgaatccactttaattgccctgctggcagcaagaaagaacaaaatcctagcaatgacagcgtgcgagcccgatgctaacgagtcctccctgaacgctcgtctcgttgcctacacctctgatcaggctcactcttcagtggagaaggctggcttgatttcccttgtgaagatcagatttctacctgtggacgacaacttctcactccgaggagaagctctccagaaagctattgaggaagacaagcaacagggcttggtgcctgtgtttgtctgtgcaacgttagggactactggagtctgtgcatttgacaggctgtcagaactggggcccatctgtgccagtgagggactgtggctccacgtcgatgctgcttatgcaggcacggcctttctgtgccctgagctccgagggttcctggagggcatcgagtacgccgactccttcacctttaacccttccaagtggatgatggtacactttgactgtactggattctgggtcaaggacaagtacaagctgcagcagacctttagtgtgaaccccatctacctccgacatgccaactctggtgcagccacggacttcatgcattggcagatccccttgagccggcgctttcgctccattaagctgtggtttgtgattcggtccttcggggtgaagaatcttcaagcacatgtcagacacggcacagaaatggctaaatactttgaatctctggtcagaagcgacccttccttcgaaattcctgctaagaggcaccttggtttggtggttttccgtctgaagggtcctaattgtctcacagaaagtgtgttaaaggaaatagccaaagctggccagctctttctcatcccggctactatccaagacaagctgatcatccgtttcactgtgacgtcccagtttaccaccaaggaggacatcctgagagattggcacctcatccaagaggctgctaaccttgtcctgagccagcactgcacttcccagccgagccctcgggccaagaacgtcatcccgccaccgccagggaccagagggctatccctggagtcagtcagcgagggaggagatgacccagcacaggcccggaagatcatcaagcagccaggagccagtctggcgagaagggaaggcggctctgatctggaaacgatgccggatccctttgatgattgcttctctgaagaggcccccaacaccaccaagcacaagctgtcatcctttctgttcagttacttgtcggtccagaacaggaggaagacaacgcggtccctcagctgcaacagtgtgcctatgagtgcccagaagtcactccccgcagacgcttcactgaagaatgggggctccttccgggccagaatcttttccgggttcccagaacaaatgatgatgatgaagaaaggtgccttcaaaaagctgatcaagttctacagcgtccccagctttcctgaatgcagttctcagtgtgctcgccagctaccgtgctgccccctggaggccatggtgtagagtcctcaatcagaatgcaagggtgcctgtgcttcagggagttggggaaccctcgaaattgcctgcagtttgtgtgcttattatgtgtgtgtgcatcttgagggaagcaagcccattattttgatcataacctcacagggtcttcgtgatccacaacagattgtaactgggaagtttaagcgggcatgctccagaggttgcaggcgcttgtgtgatagaaggggctgagacggtggcatgctgttaagcttgtaatgtgaaaaacaacttagaaataaattgtgcttatatctaaaaaaaaaaaaaaa

SEQ ID NO: 2876 - DNA, 2355 bp; single-stranded, linear
cttccacctcctgcgtgtccatctgtgagaaggagccagagcccaagggagatgatggagcctgaggagtacagagagagagggagagagatggtggattacatctgccagtacctgagcactgtgcgggagagacgtgtgacgccagacgtgcagcctggctacctgcgagcccagctgcctgagagtgctcctgaggaccccgacagctgggacagcatctttggggacattgaacgaatcatcatgcctggggtggtacattggcagagcccccatatgcacgcctactacccagccctcacctcttggccctccctgctaggagacatgctggctgatgccatcaactgcttgggattcacctgggcatccagccctgcgtgtacagagctggagatgaacgtcatggactggttggcaaaaatgctgggacttccagagcacttcttgcaccaccaccccagcagccagggcggaggcgtcctgcagagcacggtcagtgaatccactttgattgccctgctggcagcaaggaagaacaaaatcctggaaatgaaaacgtctgagcccgatgctgatgagtcctgcctaaatgcccgactcgtggcctatgcctctgaccaggctcactcctctgtggaaaaggctggtttgatttcccttgtgaagatgaaatttctgcctgtggatgacaacttctcactccgaggggaagctcttcagaaggccatcgaggaagacaagcagcggggcttggtgcccgtctttgtctgtgcaacactagggaccactggggtctgtgcatttgactgcctgtcagagctgggccccatctgtgcccgtgaggggctgtggctccacatcgatgctgcttatgcaggcactgccttcctgtgccccgagttccgggggtttctgaaggggattgagtatgccgactccttcacctttaatccttccaagtggatgatggtgcattttgactgtactgggttctgggtcaaggacaagtacaagctgcagcagaccttcagtgtgaatcccatctacctcaggcatgccaactcaggcgtggccaccgacttcatgcactggcagatccccctgagccgacggtttcgctctgttaaactctggttcgtgattcggtccttcggggtgaagaatcttcaagcacatgtcagacatggtactgaaatggctaaatattttgaatctctggtcagaaacgacccttcctttgaaattcctgccaagaggcaccttggcctggtggtttttcgtctaaagggtcctaattgtctcacagaaaatgtgttaaaggaaatagctaaagctggccgtctcttcctcatcccggccactatccaggacaagttaatcatccgtttcactgtgacatcccagtttaccactagggatgacatcctgagagactggaatctcattcgagatgctgccactctcatcctgagtcagcactgtacttcccaacccagccctcgggttgggaacctcatctcccaaatcaggggtgccagagcctgggcctgtggaacgtcccttcagtctgtcagtggggcaggagatgatccagtccaggccaggaagatcatcaagcagcctcagcgtgtgggagccggtcccatgaaaagggaaaatggcctccatcttgaaaccctgctggacccagttgatgactgcttttcagaagaggccccagatgccaccaagcacaagctgtcctccttcctgttcagttacttgtctgtgcagactaagaagaagacggtgcgctccctcagttgcaacagtgtgccagtgagtgctcagaagccactgcccacagaggcctctgtgaagaatgggggctcctccagggtcagaatcttttccaggtttccagaagacatgatgatgctgaagaaaagtgccttcaaaaaactcatcaaattctacagcgtccccagctttcctgaatgcagctctcaatgtggactccagctgccctgttgccctctgcaggccatggtttagacacagggccttcagccagagtctgaggatatacttcagggactctgtgaacccctcacaattgtatgccaactttgtgtgcttatgtgtacatgcatttttcttggggcgagttcataattttaatcaaattctcataggggttcatgacccacaataggatacaaacgaagagtttaagccagcatgatccagatgggttcagcagtctggtcagtgagaaagggccgagggtagacaggcagcttctgtggttcagcttgtgacatgatatataacacagaaataaattatgcttgtccctgaaacaaaaaa

SEQ ID NO: 2877 - DNA, 2396 bp; single-stranded, linear
agtgcgcaggactggcaagagggaagccgggctgctccacgcctttcacgccttccacctcctgcgtgtccatctgtgagaaggagccagagcccaagggagatgatggagcctgaggagtacagagagagagggagagagatggtggattacatctgccagtacctgagcactgtgcgggagagacgtgtgacgccagacgtgcagcctggctacctgcgagcccagctgcctgagagtgctcctgaggaccccgacagctgggacagcatctttggggacattgaacgaatcatcatgcctggggtggtacattggcagagcccccatatgcacgcctactacccagccctcacctcttggccctccctgctaggagacatgctggctgatgccatcaactgcttgggattcacctgggcatccagccctgcgtgtacagagctggagatgaacgtcatggactggttggcaaaaatgctgggacttccagagcacttcttgcaccaccaccccagcagccagggcggaggcgtcctgcagcagacggtcagtgaatccactttgattgccctgctggcagcaaggaagaacaaaatcctggaaatgaaaacgtctgagcccgatgctgatgagtcctgcctaaatgcccgactcgtggcctatgcctctgaccaggctcactcctctgtggaaaaggctggtttgatttcccttgtgaagatgaaatttctgcctgtggatgacaacttctcactccgaggggaagctcttcagaaggccatcgaggaagacaagcagcggggcttggtgcccgtctttgtctgtgcaacactagggaccactggggtctgtgcatttgactgcctgtcagagctgggccccatctgtgcccgtgaggggctgtggctccacatcgatgctgcttatgcaggcactgccttcctgtgccccgagttccgggggtttctgaaggggattgagtatgccgactccttcacctttaatccttccaagtggatgatggtgcattttgactgtactgggttctgggtcaaggacaagtacaagctgcagcagaccttcagtgtgaatcccatctacctcaggcatgccaactcaggcgtggccaccgacttcatgcactggcagatccccctgagccgacggtttcgctctgttaaactctggttcgtgattcggtccttcggggtgaagaatcttcaagcacatgtcagacatggtactgaaatggctaaatattttgaatctctggtcagaaacgacccttcctttgaaattcctgccaagaggcaccttggcctggtggtttttcgtctaaagggtcctaattgtctcacagaaaatgtgttaaaggaaatagctaaagctggccgtctcttcctcatcccggccactatccaggacaagttaatcatccgtttcactgtgacatcccagtttaccactagggatgacatcctgagagactggaatctcattcgagatgctgccactctcatcctgagtcagcactgtacttcccaacccagccctcgggttgggaacctcatctcccaaatcaggggtgccagagcctgggcctgtggaacgtcccttcagtctgtcagtggggcaggagatgatccagtccaggccaggaagatcatcaagcagcctcagcgtgtgggagccggtcccatgaaaagggaaaatggcctccatcttgaaaccctgctggacccagttgatgactgcttttcagaagaggccccagatgccaccaagcacaagctgtcctccttcctgttcagttacttgtctgtgcagactaagaagaagacggtgcgctccctcagttgcaacagtgtgccagtgagtgctcagaagccactgcccacagaggcctctgtgaagaatgggggctcctccagggtcagaatcttttccaggtttccagaagacatgatgatgctgaagaaaagtgccttcaaaaaactcatcaaattctacagcgtccccagctttcctgaatgcagctctcaatgtggactccagctgccctgttgccctctgcaggccatggtttagacacagggccttcagcagagtctgaggatatacttcagggactctgtgaacccctcacaattgtatgccaactttgtgtgcttatgtgtacatgcatttttcttggggcgagttcataattttaatcaaattctcataggggctcatgacccacaataggatacaaacgaagagtttaagccagcatgatccagatgggttcatcagtctggtcagtgagaaagggccgagggtagacaggcagcttctgtggttcagcttgtgacatgatatataacacagaaataaattatgcttgtccctga

SEQ ID NO: 2878 - DNA, 40298 bp; single-stranded, linear
gtaagtatcttccctctgtggctaggaagacaaggaatacatttttaaatgtctcctaaagcaaggacctgaaaccagctctatgggattattcttgttcctctttggtcaatgcagagacatgggaagaaccaccaaaggtcatgagggtctcttccagggatccctggacattgcctttcccagtggtgtgacaagagttagaggtggcctaccttgcctcctgtcctaggaggcgacagtaggagagccttcggttttctcatcctcttacttgtatgttgaactttacttaatgcaggctatatccaaaatacagtgtgaattaggctagaatagaaatgctttctattctaccttcagaaaaggaaaagggtagggtaggggaaatcatgggagagattaaaggcagagaggaaacccagatgggactgtttaatccccaagcaagaaaccactaggaaagagagataccttccctctaacttttgtattcggtgcactgacattgctctctgtgctggtgggaaattgatttctgtgccaggatgttctaggctgaggccaagagggtgctggccctttacccagtggaagaaaaaggcaagggtgaggctttgtagactttcccattcggaggtaatgatgcctccttcagccccacttcttcaaactgactccacctgctcccatctccacacccctccgtttctcatttagccaaagcacatcatccttgcagcccaccactcagcttggccaggtgcgagacatctttccccacttcatacctcccctccggccaggtgatgtttgcctcctcaggatcacctgaagtcaggagttcgagaccagcctgaccaacatggagaaaccccgtctctactaaaaatacaaaattagttgggcatggtcgtgcatgcctgtaatcccagctactcaggaggctgaggcaggagtatcacttgaacccaggagacggaggttgcggtgagccaagaacatgccattgcactccagccttggcaacaagagcaaaactccgtctcaaagaaaaaaaaaatttttttttgtcaacccatgtgggtatgaaattgtttctcattatttgcatttcactaattactagtgaggtcaaacattttttccctcatttcttatccattaaagtttattctgtgaattgccagttcatggccattttgggggtgtagtttttcttactgatttattgaagtttaatgtttttctggaaactaatattttgctagttgtgtgaattgtaaatatcttctcccactgtatttttttaaaaactttttattgtctgaattagcacatatttagtgaatgcctctatgtgcaattctttttttttttttttttttttttttgagatggagtttcgctcttgtttcccagactggagtgcagtggcatgatctaagctcactgcaaccttcacctcccgggttcaagtgattctcctgcctcaggcctcctgagtagctgggattacaggtgcccgctaccatgaccagctaattttttgtatttttagtagagacggggtttcatcatgttggccaggttggtctcgaactcctgacctcaggtgatccacccgcctcggccttccaaagtgtagggattacaggcatgagccagtgagctcagcctctatgtgcaattcttaatgtcaagctgagggagaagtctaagaagttttatataagtctgacacccagggtgcctgtaattaaaggtggaatgaaattttaatttgcgagttgatccttctgttttttagttcagtacttcctcctttttagaatgtatgctttccagataattagtgagataaagatttgattttcacttttagcatttctaaaagctgtaatatgctacctaacttgtttttaattcttgctctaacttctgatattttatagttgtgtattttgaattatattttaaaggattaagtggattattgcacatgatatttagtaaagtgtttgggagcatttagcacagcctccaaaaattagaattccactagccccctgatcctacatatctggcatcttaagagtcaataatagcaaagttgagagaggcagcttggtgtggtggaaagaacatgggtattggatccgatagccttaggttcaaatcctggcttcttcagtaattatcttctgtaattttagccaagtgtttaatttccttgagactcagtttctcgaagatgaagtagaaaatggctttcaccaggttgttgtaaagactgaatcaaatagtgtgcatgaaaattgcaaggcatagtgctcaggacatagttaacattcttaaatatatgttgaggaatggtgtgcacctgaaaattcctataaaagctgcaaatatacatgccttttgatccagctgttccacttcaggatatccttactcatgtgtgcaaagcaattttttgtagaaatgtttgtaatagcaaaagactggaaacaactgaaatgtacactgctagggaactgattactctctggtatgtccacgcaatgcagctctatgaaaaaaaggagtacgtgtcaagatatattaacaaataaagtacagaatattgtactgtacttatcccttttgtgtttaacaaaagaaagaaaaggagaaaaattagaatatagtatatatttgcctttatgtgcaaaaaaaggaaatcactttttgttttttttgagacagggtctcattctgtcacccaggctggggtgcagtggcgctatcacggctcactgcaacctcaacctcccaggctcaagcgatcctcccgccacagcctcccaagtagctgggactacaggcacacgcgccatgcccagctaatttatttatttatttttggtagagatggggtttcgcgatgttacccaggctggtctcaaactcctgagttcaggtgatccacctgtcttggcctcccaaagtgctctgggattacaggcatgagccactgtgcctgacctcttttcttcttgatgtgaaattcttcatagattagacaaatttgcccattgtgcaaatatgttgcaaatatattttctcagtttgtcatttatcttgatttttcttatggttttaaaaaaatgtgattggatttatggtttctggcattgaaccatagttataaatgtattctttactctgaggttgtccagggaatcttctaattttcttaatttaattttcatcttttaaaaacagctctattgatgcataattgatatacaaaaatagcatatatttactactatttgatgagtttggacatgtgtacacacccatgaagccatcagttaacctgatggtggtgatggtttcctgtaattttatgcttccatttttcacatttagatctgacttttctggaatttatctaagtgcacgatgtgaaagatagatacagcttatttttctttccagatggctataccttgttctaggacaatttattaaatagtccatctttttctttctgatctgagatgctatctttattatatgctaaatttctgtacatgtttaaatttatttgctccttttgtttgtctctttgtacaccagtatctacctcattgttctaattattcgagcttcaggatacattttaatacttctgggtaggaacagaaccttctcgttactcttacaaaattttcttctttattctggtttatttttcctaagaactttaaaagttggcactgaattccaaaatagaacacccaaaaacctgttgatttttccactgggattatgttaaattttcgggttaacttaggggaaaaccattatttcatgatgttaaatcttactccatgagagagcatggtacgtcttttcatctgtacaggtctttttttatattgttcagtagcaatttaaaaaaatcatccactatgttcaatgaaataaaaggccagatttaaaaatttggcaaggagttgaaaactataaaaaggaaccaaataaaaattctttttttgcccccataaggcagaagaaatacaaattctacaactgaaaaaatataatatctgatattaagaaatcaataaatggtttattatattagctacatttgaagagacaactaaaaaagaaaaatattttcaaaccaactcagaaacaagaagatggaaaataaagaatacaatgctatttatatttatatataatagtatatataatacacaagtttaacataggactgcatttgcagaatagaagagagataatggggagatagcaacacttggagaaaaaataacgaacacttttttatttaaagtgcctaacttggctgggtgtggtggctgacacctgtaatcccaacactttgggaggctgagatgggtggatcatttgagcccaggagttcaagaccaacttgggtaacatggcgaaaccccatctctacagaaaaactccaagaaataaaaaacaataatcatctgagtgtggtagcacatgcctgcgtccttgctactcaggaggtgggggtggcagaattaccagggcctggaagtcaaggctgcaatgagctgtgatcgcatcactatacttcagcctggttgacgagtgagaccctgtctcaacaaataaaaataaaaataaaaataaaaatgcctaacttggtgcttggcactttctaaaattgacacataatatttgtacctgtttatggagtatatgtgatattttgatacatgcatacaatgtgtgtaatgatcaaatcaggatatttaagatatccatcatctcaaacatttttctttgtgttcagaacattccaaatctagctattttgaaatatacaataaattattaactatagtcatcctaatgtgctattgaatattattgaattccatctaattatatgtttgtaccaattaaccaatctctacttattcctcacccccagctcccaccaaccctttccagtctctggtaactatcattttattctctacctccatgagatcaaattttttacctcccatatcgttgtcaatattattatttttcccaccctggctcctaatgaaggatttattgacaatatcactggaatctaaatcctctaggccattttttcaccaatgcccttattttcttagggcttttttttttcttaaatcaacagttttaatgagatataattcccattctataaaatttcctcgtttgaagtgtacagtttaatagcttttagtatatccacagaagtgtgcaaccatcaccataataaattttaaaacattttcagcagggcgcagtggctcacgcctgtaatcccagctactcaggaggctgaggcaggagaattgcttgaacccaggaggcagaggtttcagtgagccgagattgcaccactgcaatccagcctgggccacagagtgagactccatctcaaaacaaaacaaaacaaagcaaaataaaacaaagcaaaataaaacaaaaccaaaacccaacaattttgaacattttcatcttaccaccctgccaaaaatccctgttctccttagccatcaatcttcagctccctacccacttctaaccatgaatctattttgtagatttgtctattctcgatatttcatatgaatgaaataatataatatatggttccttgtgactagtttctttcacttagtatgtttccaagttcatccatgttttggtatgtatcagtacttcattcctttttatcatggaataatattctgttgtattgatatactacgtttcattcattcatctgaacatttggattatttccatttttgtctattataataattctgctatgaacacccatgtatacgtttttgtgtggacatgatttcattttccttggatatacacctagcagtagaattgttgagtcataaagaactctaggtttagctttctggggagcttccagattattttccaaaatggctgtgccattttacattcccaccagtaaagtatgagggttctaatttttccctgtcttcaccaatacttgttgttatctatcttttttattatagtcatcatagtctgtatgaagtgatttctcactgtagttttttcagtagtaattaaaaaatttcctacctattttagcctaaaattactttcctgactctcttcaaggagcctgccagagaattctctctctcgtgctgtctcccttatgcctgggcataagctctgataatgccctgtctgggaaaactcttttggccttctcaatttctattacattgagagcccaagaacccatggtcagtaacaggccaatgagaagcctcctgcattagtctaggtgaaggataatggtggcttggaccggaatagggtggtagtcatggaaatggggagaatttgacagactagatttattttggaaatagaactgaatctgaacagattgaattgggcagggagcagggaaagtgaaggggaaggaagacaccaggtttatgccttcagcatttgggtggatgaatggatggatgaaaggatagatggatgcatggatggtggttggatggatgagtggttggatgaatggacggtcaaggggtgaatagatgggtggatggaaaatggagagatgatgaactgagatggggaagactagaagtggggcatatttttggggaaagacagttttgcaatacgttaagtttgaggtgcctcagagtcataagagaggatttgtcagaaaggcagttggatataagattttgaagctcaaaagacagggagggcctgatggtatgtttaaacctatacggatatcacataggtaacatttcaagcctaagaaatgggccgggcgcagtggctcacacctgtaatcccagcactttggaaggctgaggcgggtggatcacttgaggtcaggagttcgagacaaacccagccaacatggtgaaaccccatctctgctaaaaacacaaaaattagtggggcatggtggcacatacctgtaggcccagctactcaggaggttgaggtgggagaattgcttgaacccgggaggcagaggttgcagtgagccaagattgcgccactgcactccagcctgggcgacagagcaagactccgtctaaacaaaacaaaacaaaaaaagccttagaaatgggcaatgccaccaaagcagaaagatgaaaggagggcaatgccctgaggtgtgccagcattggaggaaacaaacagccagagatgtaggaggaaagcccagagaaactgtgagctgcaaggatgaagtagtaacaaataaaatgccaccaagagaaccagaaggacgactggaaacaaataaacaagaaagactattgcatttagcaacgtgaaaacgttggattactttttactcagaaatcaaaccccaaggatagtgtttcccctccctacggggtttctgcaggtccctttacacgcccccttctacttctttaagtgctaaaagtgattaatttggggtgatgttttaatttctattctttttggcttataactgtgttttttcattctttgcaacaacagatagtatgttgtaatagaaaaatccattgtggtcaatgataacttctgcctgttcctgggcacagggggcatcactattagtgcctgttcctccctccctactgctgataaggaaacaggggcaggaataatactaataatttgtgctactttttctgcatacccttggccttattctggtctactgagctgggagcttgtctgaggctggagctctattgtctgaatccaggggcagaaagaactgagggctcttttacggcatccacctggaggctgcctgcaggcttgggttgctaagtgcactgcttaatttagaagcgccttttatcctggctctcttgaccagtcaaagttgtggtcgctgttttctacaaggactggggaaagaaagggtggaattaattaaacctggaggaagggactttgaagggcggagctaaggtcaaagaaagaaccctttaaataaagggcccacactggctgccagggagtgcgcaggactggcaagagggaagccgggctgctccacgcctttcacgccttccacctcctgcgtgtccatctgtgagaaggagccagagcccaagggagatgatggagcctgaggagtacagagagagaggtgagcaacgggcatccctggccctcttccctgctgctactcctgcaggaacggctgctggtgggtggcccttagattgtggggtgacatttgatgggagcattagaattgccttctgagagttggcaccagcaacatttttttttctgcgaaaggaatgtgggatcagagtgtaaaacttttctcaaccactctttcattctccctctcatatacccactctcacatatgtccacactaccgtgccttgcttttcctccccactttcccacaaaattgaggatttggatccctgagccactagatgggaaaaggggattgttcatattctgaaatagaaaaaaattttctcaatattctgtaatcactgcaaatcctttctttcttaacattcattccttcatgtgtgaatctatcagcagtgttctttcatttagtcattcatttcataaatatttagtaggtgcctactctgtatcaggcaaaaccaagtggttatccagttctcaggcatggatctcccttagcaggaaagtaggtagttgcttaaaaaagaatcttgaatgtctatttctataatgttttatatcctcctactcactaattagtgtgcgttagcttattccattgctttcctaaggcactgtcagctgagagcaagttcctgtggatatttatcttctgagtggaacacaaatacatttagcactgttcctggatcagtggagggttaggtctagagctctcagatctctggtggggccctgctggagaagaaccaggatgtgagagggttgaaggggagcagaaggaagatagaatggtgtggaaatctacctttgtctcataagttttgtctggggttggttctgttcttaagaactttgcataagctgatgcagaggggagaaactgagtcccctctcctaggtaaaagcagcccagggagtactaaggaatggatgttgagacagacaaagagatatgtacacacacacacatgcacacacagcaacagaggcactgaagactgcaatctgaaagaataaataatttgcaatagtttcagagtgttcaacttgacttttttttccttccttactcatatgttcattcacttgatacatttttttttagcatctaaaaaatatcctaagcactgaggtgttgatggaggcagcaggagggagagaaagtcattaagatttggtgccacatttcccaggccagggcagggggcttggtctggatccatggttgtgctttagggattctgtgagcctcagaaattatacacaaagttctgtgtatatgtaagcctacagttttaatcagattcttgaattaagtcctcatatgagtccaaaaaagatgaataataactgattcaatggggatggtgaaaaaatagatttttttgtcctttatcggaactgggcatggaatctttctatctgtgctaacagatataactggtgggtgtgtgtgtaacaatttttggatacaaagagctatagagtttctattgaacctataaaatagttaatagatgttctgtttctgagaaggaaagaaaggtaggagagacaatcaaaattgaagtggataaaggaaggggaaagaaaatgaaacgtttcactttggcgctagagttttgtgctttggagattttcctttttgttcatttgctcacttagaaactccctccatcattcattcactccctcactctttttttaaattctgaagataaggtcgtgcaggggatcagatcctaccctcggcccatgaatctgtctctctcttttttttgagtccaggctggagtgcagtggcacgatctcggctcactgcaacctccgtctcccaggttcaagcgattctcctgcctcagcctcccaagtagctgggattacatgcgcctgccaccacgcccggctaattttttgtatttttagtagagaggggtttgaccatgttagtcaggatggtcttgatctcctgacctcgtgatccgcctgcctcagcctcccaaagtgctgggattacaggcatgagccactgtgcccggccaaatccatctccttctttaccaagtctcttggcccggacctgagagggatgggcacaaatcggtcaggcccagtcaggggatttcagcctgatttctctatgtcacttctagggagagagatggtggattacatctgccagtacctgagcactgtgcgggagagacgtgtgacgccagacgtgcagcctggctacctgcgagcccagctgcctgagagtgctcctgaggaccccgacagctgggacagcatctttggggacattgaacgaatcatcatgcctggggtgagacacagtgaccacaagggcagttctggatttcagggcacagaagggtgggtggtggcctggagaaagacctgctttgggtcagcttgggatgagaatgcatccttcagccacttggccaccaacaccccagcccatctgctaggcatgtggagggcaggactttgactggtattaggtttctttttctttttttttgcccagttgtgccatggcatgaggtttctgatgccagggcagggctggccagaacacctgcattccagagcacagcctggcagaagtgtggaagtctaatgggatgggtggagaagtgaacattttgtctgaggggaaaggacactgtgtatagtaagacaggggagaggaagctggtggtagtgcctggccctgacgacggagccagagactcttctgtacagtgtctgagaccacaccaaagagaaggaaggaagtggggaacacatcctggcaaggacacgctggtgaccaggttgcgttggcccaggaaactgagtgggccctggcaacccctcctgtcccctctgaggtctggtgattgagctgcttttcaagagcaagaagggactttccctgaatcattgatactttccatgatggagggtgcagcctgggatagtgctggtggggccaggaagctgatggaagctggctgatgcatgggcttgagctggagcctgccttgatgggtggtggacacccctgaccactggcggtgaggagctctgccatggtgctcatgctaaagtggcatcgactcccttcctgtggcggggctccctgccatgtgccagctctgtgctggccacatgacatgctatctaatttaatcttcccagtggccctgttttacagatgaggaaactgctgatgctcagagaagttaactgtcttgcccaaagtcacagaattagtacctggtagatccaggattttaccctagaccagtcttacttcacaggctgtgccgtttctcctaccccctgtcacctctactggtgggtgcctgaatgtgcctggctaagcctgggcccctagcattgcctgtctggctccacacccccacacaagctgtgtcttccctctccctgcttggggcatttgtgttctgaaccacacatgtttagaggctcttcctgaggccagcttgaggtttgccttcatcattcccaaagaacttttgacttcaatgtgacaaaaaggccaggcgcgggggctcacacctgtaatcccagcactttgggaggccaaggcaggtggatcacctgaggtcgggagttcaagaccagcctgaccaacatggagaaaccccgtctctactaaaaatacaaaattagctgggcatggtggcacatgcctgtaatcccagctacttgggaggctgaggtaggagaatcgcttgaacccgggaggcggaggttgcggtgagctgagatagcgccgttgcactccagcctgggcaacaagagcgaaactccatctcaaaaaaaaaaaaaagtgacaaaaatatgcctagaggcaggggtgggaaaatattcaaactcagaaagtgatggcaattttgacttttttttttttttttttttgaagcaatagagacaaggtcttgctatgttgcccaagctggtctccaactcctgggctcaagtgatcctcctgcctcggccttccaaagtgttgggatgagaggcctaagccactacgcctggccatgagggcaatttcatacaaagccactcatctctttgaccattcagcctatttcacaagcattttttgaaaatgtcaatatcagtaaggctttacggaggctagatcctgataagattatctcctggattttattctgtaaaatgtaatctgctgaggggctaactgtaatctgggagtgagactgaaagcaactgtcagaagaggtggaaatgagctgattcatttgatcaagaggaattccagcagttgctgtgggtatggtcggtgaggctcatttctggaaagaggtctgtttgtttttgataagggctcttctggctattttatcttatttatcttacaagaacagactattgtctcttgatagagctaggaggtagaagcccttctctggggtttccaaaatactgtcactaaggacagtgataatgatggtcaaatctctcaactcatctctcaggccacaccagcctctgagagctggcctgaaagcagttggccctttgcttactcattttgctcagtgcctcattgaaaactgaattagtttttctcttcctgccaccacctagaaaataagagaagaagaaaaactctctttcccctttaattccaaccctggttagacaatcctcatttacttttcatgagagagagagagcatccccacgggaaaagtcaggacaccaccctgctcgggtgtctgggcttctgcctcattgcggtcacctgtccctatggggtatgtgtgaccacagggatgtggcctctctctgtcagccccagttctcgcctgcaaaacagagataatgtgtaggtcctaccccatagggtcctgtgagaagtaagtaagagaaggcttggagagcaggagatgtggttattaccgatcatgactcttacatggtgaaaattggaggaagaggtttgattctctgagtcaagtcaggatatgtgatgtgtctgtcacccacatgattagtttaccgttaatgttagagcttaacatttcacacatttcttgcccacgcctccacccacacaacaaccctaggagacaggatttattttacgatgagaaactgaggttgagggaggtgcaggagaggctcctggtcttatggggtctgtactgtaaacactttttgagacctccttttgaaaaacaaaaaagaaggaggccggacacagtggtgcacgcctgtaatcccagcactttgggaggctgaggcgggtggatcatgaggtcaggagttcgagactagcctggccaacatagtgaaacactttctctattaaaaatacaaaaaattagccaggcatggtggtgggcacctgtaatcccagctacttgggaggctgaggcaggagaatctcttgaacctgggagccaggggttgcactgagccaagatggcgctgctgcactccagccctggtgacagtgcgagaatctgtctcaaaaaaaaaaaaaaaagaatgaatctcaaaagagacccacacaaatggtatgttggagcttaagttcattagcttcatggtaaatctacacggtcacacagctggttagggactgaggtgggatgggaacttgtgtccttggacttaattcttaggctccttatactatacacactgtccaggacaaggtccttgctcttgaaggactctaagtatgtgtggacagtaaagaacaggatgatgccctaagatgttatcaaatgagtcctcagtagagtgaaacatctagaattctagagttctatcgctcagggaagggatcgaagggagctgtgggagctgggggagagttcgaggaggaaatgaatatttagtagctttctaagaactggcaggttttggaaggtcatgtctttatagagagtgcctttctatcaggggacacagcattgctcaaagacataaatgcagaaaggaacagggcatgcttcagagcagtgagatgaggagagatgagataatccatgaggccgatgaaccaccagggctgcttctgagttctgatggggggcccttcctgcccactcagctcctccttacatccggttttgattgtgggctcagggcttagcctggaggtcggcctcccatacgcttggtctgggctctcctctctaccgtctcctttcctcactacattcccaatgtgatgcttaaggacagctttgaacccattcacccagaccctctgagttgcatgctcagggagctcagtgctccataaaacaaaaacaaaaggtgccttttgcaagaaactggatgaaacaagtagtctgcttttctggagctcacagtctgcccttccttttttttttttgagacggagtcttgctctgtcgcccaggctggagtgcagtggagcgatcttggctcactgcaagctcagcctcccgggttcacatcattctcctgcctcagcctcctgagtagctgggactacaggcttctgccaccccgcctggctaatttttttggtatttttagtagagatggggtttcaccatgttagccaggatggtctcaatctcttgatctcgtgatccacctgcctcggcctcccaaagtgctgggattataggcatgagccaccgcacccggcctgcccttccttttattgctgggcaggggcggcatgaggggtaagtactggggactaatgtgaataccacccagaatcccacaactgggttactgtagtgattttccttttgcatatttccttctggactttgcatatatgaaaaggctccactgatgatctagcataggacatgggccacattagtgacaagaacaccagtgaacaagtctgattttcatggagttatgtcacttatttctgcttaaaagtgtcagcccatctctagagtgacacttcaccttgccagagatggtctctggagaaagaaagcctgctggaaatgcctcctggtgccaactctgtgcatgctctgcctccaggtggtacattggcagagcccccatatgcacgcctactacccagccctcacctcttggccctccctgctaggagacatgctggctgatgccatcaactgcttgggattcacctgggtgagtagcaacggctgtaactactcgcaatggggaacgtagcagggagtggtatcctagggcagacatattttgtcttggtttctgaatatggctccacaataaatattaatgagggctatattctttaagcttacgctttattttaattttctcatcacatcctttaaccctatggaatcacgagtattgatcccattttgtaggtgaagaaatcgaggcttaagcaacttatctcccccagatcacacagctcatagagacacagataagacttggatacagatctggttattgccacagtttgtgaccttacctaagcaatttgatgcctattgagtcaccacttcctctgtgctcttgtatttgagtagctggagatatgtcctaagacttcccttaataaccccttaagcaccactcagctttaaatggtgccaaaagccttccagaacatctttttattttaagcctgaactcctatgggtgtgtgggtgggtgggcgggggtattcatatcttttctaggaaaacatccccctgggcatttgaggacttctcagctatgtattttagcgacttggagaaccaaatccaagccaaccatttctagggctgtttctccatagagccttggagaattcgcctcattgagggcagcatgaatccaaaaccccacattattttctcttttggttgacagagagtggaccaggagagaggcacgtggcctaacatgaccccttctccagaaatgttcccattgacaccatcaggggcagacatgtttctggagctcgtgggggcacctcagtgccctggggctgtgcagtttgaagttccttttcctttctcaggcatccagccctgcgtgtacagagctggagatgaacgtcatggactggttggcaaaaatgctgggacttccagagcacttcttgcaccaccaccccagcagccagggcggaggcgtcctgcaggtacctcccttggcaaagcttcacctagcttgggggctaagtagcgaaagacaagccaaaccctaacctggcaattctcccgttctccatggagtttcccccacattacccacaccgtcatcaccaacagcaccatcatcacagcttcacctctactcccacctcagcttctgcttcattcacatgtactgctacttcctttgaaagaaattaaagagccaacacatgatcacatttccagtatgacttgattcaggtttcttagtctataatctgacaattcctttttggtgtcccattttgtatctcacggtaaaaggggaaaggagaaggcaaggagaggacttctctttctctccctgctaggttcaggagatccccttgcagtgagagcaattaacagcataaactgattaacggtatcctctgaccctatcttctggatacttgtcaaattatggttcttcaaatatttctttttttcaagagtagtgccatggagtggagctttctgggtgcctcccatggaccacacacattgttaggtgcttttgcatctataaatccttgacgttcatgagggcttggttctaagacctttgagattcctcagattcttgaattctttttttaaataaaaatcgtggctggacatggtgactcaccctgtaatctcagcacattgagaggctgagacagatggatcacttagcccaggagttcaaaccagcctgggcaacatggtgaaactgatctctccaaacaaacaaaattagctgggtgtggtggcatgtgcctgtagacccagctacttgggatgctgaggtaggaggattgcttgagcccagaagattgaggctgcagtgggctatgattgtgccactgccctccagcctgggcgacagtgtaagaccttgtctcaaaaaataaaaaaattgccatgttgctctgagatgagaaccaggaagttcactaggtcctcttgctagctaagtgactccctctctcactgcagccttgcagcaagattaaaatctgaacctcggaagaaagacaaattgcagcatgttgtggacattttggattgtcagcaaatagttacaacttcagatatcatatttgggagaacatgctaaatgtctgcggtacatgatcttgcttttcatctgattatctcaggaaccctgcaggtgaatagtaccattccccaatgttttgagataagagcactgaagttcagagagattaaataatttgccctagcttacacagctgataagcagaagaacgaggattcaaactgatgcctgtctaaatccaaaccatgctttctcctgtatcgtcagccatgtgaacttgagttagtcccatcacctctctgagcatcactctcctcatcttagtgtgacaagaatcataattatctcaaagaggtgttgtgaggagcaagtagaatgccagaaagtgttttgtaaactatgaattgcaatacagatggaaggtgttgttaccattattattatttttaaaaacagggcctggttctgtctcccaggctggagtgcagtggagccatcatggctcactgcagcctccatctcctgggcccaagcaatcctccaacctcagcctcccacgtagctgggactacaggtgtgcaccactacacctggctttttgttttttgttttttttgtagagacagggtctcactatgttgtccaggctggtctcaaactcctggactcaagggatcctcccaaagtgctgggattacaggtgcgagccactgcacccagctgattattattattattatgctacatacttctttacataaatagctttctttttatggagtaactcccaggcacttaatatctgtgggatctggtccacaccactctccatgacagtgtctgccaggcatttttagcaggattctatcagctgtaggtcacttgaagatttcaagaagcaaagacatcaaagactgggtgaatgaatgataaggaaccataaagactcctgtgaagttcctgaggtggccccgaagatttccacaatcatggccagagcaaaatcctacccaacccttgtttggataatctatactcccatcctgggaagcagttaaagggatgctctccatttcatagacagaaaagagtcttctggaggggaaatgttagcccaaggtcacaagagctattgacaactaaatgggcccaagtcaccagcctctcacacaggccaggatcctctcttcctggggactcaaactccatatccatttgtgtaataagctgagagttcttcttttaaatatgttttacatggggagcaaacacatccaggagggacagaacattctctttttggtttctgtggcctctgtaatagagaggctggtattaggtgcaaacttattttagaaggcagaataggaatgaaagttggggagggacatgggcaccctgggcaggaggagctgtgtatttccttctgtgaatagctatgacacacacatacacaaacacatacacacacagagagagagagagagagagagagagagagagagagagaaaaaactagaaagcctggggaaatttggcaagagaatacagaaaggctgccatgataatccttttcccctgcagagcacggtcagtgaatccactttgattgccctgctggcagcaaggaagaacaaaatcctggaaatgaaaacgtctgagcccgatgctgatgagtcctgcctaaatgcccgactcgtggcctatgcctctgaccaggtgagttgcccgacgcaggacagcccttcgggttggtgcttggcttctggaatcttggtccttgagcaatttttttctagacgtgagtacgctggggttctgagcagctcagacatgggagcttgtctccagcaactgtagggaagacaagcttccaatgatcatatttggttcccgagtcttaggcttcagcagtttctggggggtgatcattccaggatgactctttgctgacaggtttctgtggcccttctaggctcactcctctgtggaaaaggctggtttgatttcccttgtgaagatgaaatttctgcctgtggatgacaacttctcactccgaggggaagctcttcagaaggccatcgaggaagacaagcagcggggcttggtgcccgtctttgtaagtcaggatatatgcctaagcttagaatgatagaacttggatgtgaggaaggaattttggcagaattcaggtaagtaacatgctgcacacaaaagcagaaaggtcctcccatacagtattttacacatcatgaggtgctatccataggtgtgttatggaataaattttgtgggtcataaccagcattaaaaagaaatatagtataaaatattagagtgcacacatatagccagagtatgtattgttttatgaaacttttttttcaaatacacacgtatacatgtactagattgttatataaaatgtgtttcttacgagccatggtaaaacacagtctgaaatatacactgttctggtgggatggatgggagtagatcacgtctgtggtgaaatctttctcaggccaaatgtgtcacacgagcccaccctcctgtgttaacttgccttaattttcccctaggtctgtgcaacactagggaccactggggtctgtgcatttgactgcctgtcagagctgggccccatctgtaagtatcttccctctgtggctaggaagacaaggaatacatttttaaatgtctcctaaagcaaggacctgaaaccagctctatgggattattcttgttcctctttggtcaatgcagagacatgggaagaaccaccaaaggtcatgagggtctcttccagggatccctggacattgcctttcccagtggtgtgacaagagttagaggtggcctaccttgcctcctgtcctaggaggcgacagtaggagagccttcggttttctcatcctcttacttgtatgttgaactttacttaatgcaggctatatccaaaatacagtgtgaattaggctagaatagaaatgctttctattctaccttcagaaaaggaaaagggtagggtaggggaaatcatgggagagattaaaggcagagaggaaacccagatgggactgtttaatccccaagcaagaaaccactaggaaagagagataccttccctctaacttttgtattcggtgcactgacattgctctctgtgctggtgggaaattgatttctgtgccaggatgttctaggctgaggccaagagggtgctggccctttacccagtggaagaaaaaggcaagggtgaggctttgtagactttcccattcggaggtaatgatgcctccttcagccccacttcttcaaactgactccacctgctcccatctccacacccctccgtttctcatttagccaaagcacatcatccttgcagcccaccactcagcttggccaggtgcgagacatctttccccacttcatacctcccctccggccaggtgatgtttgcctcctcaggtgcccgtgaggggctgtggctccacatcgatgctgcttatgcaggcactgccttcctgtgccccgagttccgggggtttctgaaggggattgagtatgccgactccttcacctttaatccttccaagtggatgatggtgcattttgactgtactgggttctggtgagtgtagcagcccagctccgagcacgcaggaacgccttgcctcctctggagagacctcagccactaatgcccatttggaaacccacagggtcaaggacaagtacaagctgcagcagaccttcagtgtgaatcccatctacctcaggcatgccaactcaggcgtggccaccgacttcatggtgagtggccagggacgggcagcctggtgggctcgggtggccagtgggaactgtaggcgtctgaccccccaaaatctgtacggtggctcccttcagaaggcagcacactatgagctcatctcataatactgccaatgcataccttggtttctaattgtgcctaagtatatagaatgaaacccagaaaatggttaaaaaccctagaaaatgagaccagcctttgaggcagtgtgcacatttcctgaatatttgtggcattttttaattcccagaaatgctcttcctaccacaggtggaccagttccttctgcctccatctcgggtcatcttttttgtttcttacccagcagcagggcagggtggagaatttccctggtggggaaagagctttcttgctgaaatcgcttttgtttttttgtccctgacagaggcgctgtggggcagctctgtggtagtgatgggctgcaggacttgtgtgaggttctggaagcctccaagcattcctgactttcccaactgactgcgcctcaactctctaactcactctctctctcttttcttttgttttctttctttctttctttctttttttttttctgagacagagtctcgctctgtcaaccaggctggagagcagtggcgcatcttggctcactgcaacctccgccttccaggttcaagcgattctcctgcctcagctttccaagtatctgggactacaggcgtgagccaccgcgcccagcaaacctcaactctcttgattccacatcctcagccagtattttgcctgagggaaacgagttcttaacaaattgactccgcagtttgaggatgagcccttcctttacttgtaggggagacagggatgtaaacgaatgtattacacataacctggccaacggaggcagcagagcagagtgggggcaagcttggtttggaattccattccagcagtggccctttgggaaactaactggacctctctgagccttgctttccttatctgtaaaatgagaatagtggcattgattcatagggtattgtgaagcttaaatgggaacacgtgtggatcacctagcaaaatagccgtgtggcaagtgctcaatatatggtaggcatagtatttctgaaagctcttctttgaagctgcagagatttgttaggacagtggttaggcatgtaggtgctaaagccagatggcatgtgttggagtcctggctttctgtttactaacttgtgtgacctcgggcaagtgacttaaactctgtgtccagatttcctcttgtgtcaaatgaggctgatgaccacagttctggcttcttaggcttgctgtgaggattatacaaattaatacactgaagtgctgagagcagtgtctgacccctgtaagcatccttccttgtgaagagatggttttatcttatcttcttggacaactgaagtgtcttgcccttttagtcttaaaataatagcttcgtcatcacttgattatactggctattctcccttggaccagtccacaccctctttagatatttgaagcttttggattagaattgcagcggtaagcctcacggcttactggtggtgacagaagaccctctagaggtaaagaaagaaagaaaaataatggttctttatctccactgctctttctggtaggttttcagagatttttaatgaaaaattaaaaaaattccagaacagcccaagggtcagatatctttagggataactgtaggtttgcttcctgagtgtgaattgatgcccattctcctatgagtgtatttgggtcatcataactgaggagcattatattcacccttgcccttttgaatttcatgttaccgtttaaattcatttaccacagtgcctcaggatcttcccggggttcattcctaggagtttggagattttacagtgctctctgtcttccagataactcataaaaatgttagagtaaactcttcccagccctgctctggggaaccttattatttttacctctccacccagaaggcactgccttacacttacccttcccccacctttaatcctatggatttgattttcaagtccatgaagaaactcctagaaaagtgaagttgctatctttttcatgatcctgagggtcctcagagctactctcacctgggcccaatgtctttcccacccaggtggctgcagctttgaacagaagctcagtcctgctctgagatgagccagaaacagggcagcatcccaggagagaagacttaggtgcttaacccctggggtcctggaatcacctaaaatcagggctagattctctgacagcggagaagctccctgttttctgcctctcactggacagagagcaccagtggagggagcgttaccttagccttggcaagggagccctgcaaggaccttacaaggacacagaggaggctggagatgcctcaaggtaaagaagagccctgtcaggctttatacgtccagattttttgatccaacagaaaatgttggctagaaccactctgctgagtcagcatggatcagttttggaatagtgacaagaaaaggagcaactgggaataaggaagattgtgaagaaatcaaaataaaatcacctctgcctatcctggtttatttgctggtaaaataaagtagctctctctatatatgaaataaattggctataactatctggaaaccagaaccttttgacagatgatccctatcatccgttcattattctcttggagtgtccattggacaagaggtggagttgacactttccttgttacagcaattttgttccattttcaggttttgatgccttctgctggcacaaaagcccccaagctgctccccagcacaacagagttttgcttggaaatcaaaggcttagtagttttctgctggggaaacattgtccatcaacaaaggggtaacatcccaactgtgcctggctcaggaaactggggtgaagggtgaaggtgaggacatttgtgaggatttgataatcttgtgtatgggcagataaatacgcagtgggacaaacatttatttttagtcaacagaaattgtggtagaaactttctgacgtttgagggagatgtcattaggaaaccacgtgactcattagaataactgtaaatgttttccaaatcctctgctctattttcagatctgagaaatcagtctgaaattgatttggaaattttcagatgtatggtgactgcaaccttgaactttaagctctgttgaatttggccaccaggagcaaagagtcaattttcatctaacagcggcagaaatttgggtgctcatttgaaatctgacagctggagtgatggctctcagatcacaggaatctcacaggaaaatgaacaaggcagtgtaaggttaaataggggtcatcttggctctagacagaaatgctactgtgatttgtagctcacattttaaaataatctaaatagccaacacctactgacaacttcttctgaggctcttggcgttctttgtcctcacaccacttgcccgggaggtgcaattggttctttatgtcccggactgatgagccagtgaggtggcactacccaaggtcacacagctagtaagtggcacagctggaggcgaaacctaggtctgcagggctctagtgtctgtgctctaactaccatactttacattttgggaggaataaaaatagaactttattttctgctattcaaggaatatagattcatttagagtaaaaatgtatttcccttatgttgagtttctgggccgggatgaaatgtttaaagcagcacttgaaagcaaagtgcccttctcattggttcagggtaatggacttgacttccacttgtctggctctcagacaagtgactattggccaccttcatcagtgatttggtcacacgatggggcaacccttggggagcttggcttactccttagcaacagctcccagagtcatggtgacatcgtccatccctggagggctgggcaggcaacagataatgcccagaaatgcccgagggagtggggcacccttgtctctaaccttgggcactgtgttcctttgtttctagcactggcagatccccctgagccgacggtttcgctctgttaaactctggttcgtgattcggtccttcggggtgaagaatcttcaagcacatgtcagacatgtatgtagcatgctgctgtgggggctgagcctgtgttcctctgttttctcatggcgaggaaggctggtttctactttgcagatctgcctaggagacttgcggtgtgtggttcaggtgtctgggcctgttcctcagctcctgggacttgattctctttgttaaccagaggagcgctgagcacaacatgccctgagggctgcctgatgcctgtcctctgctgagtgtctcaccgttccccttgctgtcactgagcactggggagggttggccccagagtctggtttgcaggaaagagaaagagaaagtaaatcaaggggaagtgtgtgtggccagggtaggatcctatctgctttggaattacctcaatggtcacagctggctgaatacttttagcactattatgattatgcctgaaataaagctcccctggccttggacaggtagacctaccaagtctggaacaaacctccctgcatcaacaggcatttattgaaggcctattttgcttaatttatttctattcaattcaacaattacaaggtattgtgctaagaaagggacacagaggtaaatgagacaggtgcagcctctctcccatgttcttcatggaagaagcgggacttaactaagaactctggccactggcattgttctcccacttctacaagagtccacatgcaagacaaagccattgataaaagtagtgggggaagctgaagacactgtcctttctgcctatgtgtgtctttgtccttccacctttcctctagggaattccttcttggttaaacaaacacaaaccaaaatgaagtggtggaagcggtaactatgattttttttaacatttaaaaaaaataattattatgcttacataataattacgtatatatttatggggtatgtgtgaggttttgatacaggcatacaatgtgcaatgatcaaattagggtaactgggtatccaccactcaaccatttatcatttctttgtgttagaaacattctagttccattctttaagttagtttgaaatgtacagcaaattatagttaactatagttgccttattgtgccgcctaacattagatctatttaattgtatttttgcgcccgttaactatcacctctttatcccccattccctgctacccttcccagcctctgccaaccatcattctactgtgcgtctccacgagctcagtttgcttactttttaactcccacgtttgagtgagaacatgtgaaatttgtccttctgtgcctggcttattttgcttaacataatgttctccagtttcctatgactggttttaatgttggtaattttacctttgtaatcaccactggttgtttaccaatgagcagctgccaccaacaatattgaggaactttaggcactttgtgctgtttctagaaatgcagactcaagactggagggttgtgggcggggaatggttggtggaggttacaagtaattaggaacatttttttgcttacagtttgggactggatattcaatgtgcagatcctgactaacctcccttagcacttctgtttgcaaatcaaacccctgaattcctcctattagcaaccccattgcctaccatatgaggcccacactcctgggcctggctttcaaggacttgacgattagctcctaccttagcttgggcatttcatcgacccatccagacctcatgctcagtccatctctgcaccttcacccgtgtccttcacctgaactaccctctcctctccaaatgttgtgaatggattaaattctgcttccactagaagcttttctgcctattccatctgttctggtttctgcttcattagcattcctgtgatcacctactcaaacacctttacaaaactgtgctcaaagttcttccaatgtcccacaatagaagaaatggaattaaaataaagttgtttgatatgatttgattttatctcttcaacttgacggtgatgataattattgacacttgcgtaatgccttcaatacaaaaataaattctagttcttcattagatccttagcacagtgcctggggtggtcactctaacctggcaaggctcagagggagtaattgccctgcttgagggaagaaggcccgggactttccctgaagcctcccaattccaaatcctttcttcatagttctgggctgctttctactacactgagctcttggaaagttatataaaattaaatttcatatttctgtgttacagagaagtgctttaaagaatggatttttagttctaccctttacctgtttgatgaccttagacaaattacttaacctttctatatttgtctgccttatttatttattgttatttatttttgagatgcaggtctctgcttgctcaggctgaagtgcggtagtgccatcagagctcactgcagccttgacctccccaggctcaggtgatcctcccacctcagcctcctgagtagctgggactacaggcgcataccatcatgcctggctactttttgtattttttgtagagatggggttttgtcatgttgcccaggttgttctcacgctcctgggctcaagcaatctgcctaccttggcctcccaaagtgcgaggattacaggcatgagccaccacccctggccatgccttcctaatttataaaaatgagaaaaggatactacctctctcaaattaaatgagataatatatatgcagcccttagcacagggtctacctactactcagttaagtactcaatgagtacctcttcctcttctcttcttccccttcttcatcatctccttcttcatctaattataataaattgtcatcatcatcaccatcatcatcatcatcatcctcatctcctatcacctacaatagggattggtaaacatttcctgtaaaaagccagatactaaatacttttggctttgtgggccatactctattgtaattacctctgtactacaagagctaccgtagacaatatgtaaacaaatgggaatgctgtgttccaaaaaactttacaaacacaggtgggggctatatttggccatggctgcactgtgcctgcccttgacctagagcggtgcagggcactggcagcagctctgctttcatgacctgtaaagtggggctttggaggtggcagtgctgcctgtgctctgtattctcctctcccctgacctctgcttctgttattgcaaacagcatgtgttgtaggagggataaaagcacagtgggaggagatctacctactgtcacttgtaccttgggaaagtcactttcccttggttccttctaaaaaatggaaagattgagctgggcacaggggcacgtgtctgtagtcccagctacttgggaggctgaggtgggaagctcaattgctcccaccatagcccaggtgggagttctgggctatggtgtgctatgccaattgagtgtccgcactaagttcggcatcaatatggtgacctcccaggagcaagggatcaccaggttgcctaaggaggggtgaaggggcccaggttagaaatggagcaggtcaaaactcctgtgctgtttgaaactgaccacgcaggggagaaaggggctctgagaaagatttggagaaactcatttcattatggtcaaaagacaggctcagggccagacatggtggctcatgccagtaatcccagtactttgggaggcctaggaaggaggatcgcttaagcccaggagtttgataccagggtgaacaacctagtgagaccactgtctttacaaaaaaattaaaaaatgtagctgggcatggtggtgcatgtctgtagtcctagctactcaggaggtgaaggtgggaggattacttgagctcaggagttcaaggctgcagtgagctttgattgtgcaacatgcctctgtactctagcctgtgtgacaaagcaagaccctatctctcaaaaaaaaaaaaaaaaaaaaaaaaaagaggttcagctaactcccttgccctctcttgaaatagagcagtaagtatgagaactaactgatagaattacttagcaaatatttttattgagatcttctggatgcttggagaaatttttaaaaagaaaagagaaggcaagtcctgtccttgtttagttagtaatcctgggttaaaaacaaaaagcaaaaaaccccaggacatttaaaaagatggtatgaacttcagtggaagattaatataatacaaagcctttaacattttaaaatgtaacaaaatattcataccatagaatgtaccattttactcatttttaagtgtacaattcagtggcattaagaatactcacaatgtggtgtgaccatcaccattatttccagaattttttcatcatcccgagcagaaactctgtatccattaaccaggtccaaaacctttccatgatgggtggagacaagatgtgaaaatatgttctctatggaatgtcagaaacaggggatgaaaagggcatttggggtacagggtgagaagaggtttgagaggcaagtgaagcatgtaggcttaggatggggcagggccgccactagcccatatggcaacttgatgtgcactacaaacaggcatctcttcctttaggcacacgcagctcgcatgaggcacctggctgggaacgcagagcatggactgggttttggccctcacttgcccacttggccagtcaaggagctgtgaaatcaggagttgaggccgggttgcctggactgcaaagcacatgccttctgggttctggggctgagttgaaagagggccctgagatgagttctcgaggtggatcccatgtgacaggaaacagggcgccattggaaattttccagcttggaatatgagcaaaatcaaatggagatgacaatgaggcagaagccgcttacaacggctgtgacgggaagatggccctggtttaaaaccatttagcagtctgaaagtttatgcatagtctcttgtctgatgattaatctcagttctctttatacttgcaattccagggtactgaaatggctaaatattttgaatctctggtcagaaacgacccttcctttgaaattcctgccaagaggcaccttggcctggtggtttttcgtctaaaggtaataccatcttccaagcccctctgtgaatgatgtcttgtggtgctccagagcctctcggaaacacaaactgggctctggggatgctgacagggggtgcgatggagacttcacttcctttatttttcaaacagggtcctaattgtctcacagaaaatgtgttaaaggaaatagctaaagctggccgtctcttcctcatcccggccactatccaggacaagttaatcatccgtttcactgtgacatcccagtttaccactagggatgacatcctgagagactggaatctcattcgagatgctgccactctcatcctgagtcagcactgtacttcccaacccagccctcgggttgggaacctcatctcccaaatcaggggtgccagagcctgggcctgtggaacgtcccttcagtctgtcagtggggcaggagatgatccagtccaggccaggaagatcatcaagcagcctcagcgtgtgggagccggtcccatgaaaagggaaaatggcctccatcttgaaaccctgctggacccagttgatgactgcttttcagaagaggccccagatgccaccaagcacaagctgtcctccttcctgttcagttacttgtctgtgcagactaagaagaagacggtgcgctccctcagttgcaacagtgtgccagtgagtgctcagaagccactgcccacagaggcctctgtgaagaatgggggctcctccagggtcagaatcttttccaggtttccagaagacatgatgatgctgaagaaaagtgccttcaaaaaactcatcaaattctacagcgtccccagctttcctgaatgcagctctcaatgtggactccagctgccctgttgccctctgcaggccatggtttagacacagggccttcagccagagtctgaggatatacttcagggactctgtgaacccctcacaattgtatgccaactttgtgtgcttatgtgtacatgcatttttcttggggcgagttcataattttaatcaaattctcataggggcttcatgacccacaataggatacaaacgaagagtttaagccagcatgatccagatgggttcagcagtctggtcagtgagaaagggccgagggtagacaggcagcttctgtggttcagcttgtgacatgatatataacacagaaataaattatgcttgtccctgaaacaaaacataccctgtgtcacttaattggctgctgaaacattgattaaccagtctgggagcttaaacatatgtactttttttgaagcatcaattatgagtcaggcactgtggctcatggttcataaatgaggaaaccaacgtttaggtcacacagctttaaataggcaaacccaggtctcctgcttccagtgaagcccaggctgtttccaccatgcagtactgctcaaggttggacctgaacaggagctcacagcccagcaggctgctggtcctccagtacatttaaatgtttcctttctaggtttggaacttgtgcattttccccttattttcctggacccggtagtcaaataaaagctatgctcacaagtggcttgcccataattagttcagaggccaaacacataattttatttccatttcagatggtactttgataggttgtgactctgaaatgggttatgtaaagagtattaaagacaaacaaagctgggcattagttagaactttaaggatagatgttaaacagtaatatactatcacaatagggaaaagggtcccatgtgaactgaactcaacttggatttgtgcaaaggtgactaggcatttcacagcgtgaatgggagaatagggagaaggccagcctagacttagaagagtcaggaatgtgaaaaattacaaaaagcggaaagtggttgatgtgaaacccctctgggtttgctaactggtgctttttgaagtaagactcttaccctcccacagagactgggagtcagggccctgtgttcaggggttcgctggaacaaacagttaattctttcggcagctttgagttttcttaagcaggcactttaaggtgagctaggatcaacttagggatgtggccttgagctgtgagaaactgtgttagtgtttgttcaagtctttataggcaaaggttgaggcctagttgagaagggggctcggaggagcttagctagagtttggtcgagaaaagaatctttgttaagagtttaaagcttttttttttttttttttttttttttttttgagactagtgctttctctctttcccaggctggagtgcagaggcacaatcatgtcttactgcagcctcaacttcctgggcttgagcaatcctcctgcttcagcctcccaagtagctatttatttttgagatggggtctcattctgtgagtgcagtggttggaacacagttcactgcagcctcagcctctgaggctcaagctgtctttccacctcagtcccacgagtagctgggactatgagtgcacaccactatgcctggctaatttttataactttttacagagacagggtctccctgtgttgcccaggctggtctggaactcctgggctcaggtgatccgactaagaagccctgttgacagctgccttccagcctcctctgtctgtctgccaggaggagcaatccaagggagatgatggagccctgtgaataccgtgaataccgtgaatactaccgagctagagggaaagagatggtggattacatctcccagtacctgagcactgtgcgggagaggcaggtgactccaaatgtgcagcctggatacctgcgagcccagctacctgcgagtgctcccgaggaacccgacagctgggacagcatctttggggacattgaacgagtcatcatgcctggggtggttcactggcagagcccccacatgcacgcctactatcctgctcttacctcatggccatccctgctaggagacatgctggccgatgccattaactgcttaggattcacgtgggcatctagcccagcttgcacagagctggagatgaacatcatggactggctggcgaagatgctggggctcccggagtacttcctgcaccaccatcccagcagccgagggggaggtgtcttacagagcactgtcagcgaatccactttaattgccctgctggcagcaagaaagaacaaaatcctagcaatgacagcgtgcgagcccgatgctaacgagtcctccctgaacgctcgtctcgttgcctacacctctgatcaggctcactcttcagtggagaaggctggcttgatttcccttgtgaagatcagatttctacctgtggacgacaacttctcactccgaggagaagctctccagaaagctattgaggaagacaagcaacagggcttggtgcctgtgtttgtctgtgcaacgttagggactactggagtctgtgcatttgacaggctgtcagaactggggcccatctgtgccagtgagggactgtggctccacgtcgatgctgcttatgcaggcacggcctttctgtgccctgagctccgagggttcctggagggcatcgagtacgccgactccttcacctttaacccttccaagtggatgatggtacactttgactgtactggattctgggtcaaggacaagtacaagctgcagcagacctttagtgtgaaccccatctacctccgacatgccaactctggtgcagccacggacttcatgcattggcagatccccttgagccggcgctttcgctccattaagctgtggtttgtgattcggtccttcggggtgaagaatcttcaagcacatgtcagacacggcacagaaatggctaaatactttgaatctctggtcagaagcgacccttccttcgaaattcctgctaagaggcaccttggtttggtggttttccgtctgaagggtcctaattgtctcacagaaagtgtgttaaaggaaatagccaaagctggccagctctttctcatcccggctactatccaagacaagctgatcatccgtttcactgtgacgtcccagtttaccaccaaggaggacatcctgagagattggcacctcatccaagaggctgctaaccttgtcctgagccagcactgcacttcccagccgagccctcgggccaagaacgtcatcccgccaccgccagggaccagagggctatccctggagtcagtcagcgagggaggagatgacccagcacaggcccggaagatcatcaagcagccaggagccagtctggcgagaagggaaggcggctctgatctggaaacgatgccggatccctttgatgattgcttctctgaagaggcccccaacaccaccaagcacaagctgtcatcctttctgttcagttacttgtcggtccagaacaggaggaagacaacgcggtccctcagctgcaacagtgtgcctatgagtgcccagaagtcactccccgcagacgcttcactgaagaatgggggctccttccgggccagaatcttttccgggttcccagaacaaatgatgatgatgaagaaaggtgccttcaaaaagctgatcaagttctacagcgtccccagctttcctgaatgcagttctcagtgtgctcgccagctaccgtgctgccccctggaggccatggtgtagagtcctcaatcagaatgcaagggtgcctgtgcttcagggagttggggaaccctcgaaattgcctgcagtttgtgtgcttattatgtgtgtgtgcatcttgagggaagcaagcccattattttgatcataacctcacagggtcttcgtgatccacaacagattgtaactgggaagtttaagcgggcatgctccagaggttgcaggcgcttgtgtgatagaaggggctgagacggtggcatgctgttaagcttgtaatgtgaaaaacaacttagaaataaattgtgcttatatctaaaaaaaaaaaaaaacttccacctcctgcgtgtccatctgtgagaaggagccagagcccaagggagatgatggagcctgaggagtacagagagagagggagagagatggtggattacatctgccagtacctgagcactgtgcgggagagacgtgtgacgccagacgtgcagcctggctacctgcgagcccagctgcctgagagtgctcctgaggaccccgacagctgggacagcatctttggggacattgaacgaatcatcatgcctggggtggtacattggcagagcccccatatgcacgcctactacccagccctcacctcttggccctccctgctaggagacatgctggctgatgccatcaactgcttgggattcacctgggcatccagccctgcgtgtacagagctggagatgaacgtcatggactggttggcaaaaatgctgggacttccagagcacttcttgcaccaccaccccagcagccagggcggaggcgtcctgcagagcacggtcagtgaatccactttgattgccctgctggcagcaaggaagaacaaaatcctggaaatgaaaacgtctgagcccgatgctgatgagtcctgcctaaatgcccgactcgtggcctatgcctctgaccaggctcactcctctgtggaaaaggctggtttgatttcccttgtgaagatgaaatttctgcctgtggatgacaacttctcactccgaggggaagctcttcagaaggccatcgaggaagacaagcagcggggcttggtgcccgtctttgtctgtgcaacactagggaccactggggtctgtgcatttgactgcctgtcagagctgggccccatctgtgcccgtgaggggctgtggctccacatcgatgctgcttatgcaggcactgccttcctgtgccccgagttccgggggtttctgaaggggattgagtatgccgactccttcacctttaatccttccaagtggatgatggtgcattttgactgtactgggttctgggtcaaggacaagtacaagctgcagcagaccttcagtgtgaatcccatctacctcaggcatgccaactcaggcgtggccaccgacttcatgcactggcagatccccctgagccgacggtttcgctctgttaaactctggttcgtgattcggtccttcggggtgaagaatcttcaagcacatgtcagacatggtactgaaatggctaaatattttgaatctctggtcagaaacgacccttcctttgaaattcctgccaagaggcaccttggcctggtggtttttcgtctaaagggtcctaattgtctcacagaaaatgtgttaaaggaaatagctaaagctggccgtctcttcctcatcccggccactatccaggacaagttaatcatccgtttcactgtgacatcccagtttaccactagggatgacatcctgagagactggaatctcattcgagatgctgccactctcatcctgagtcagcactgtacttcccaacccagccctcgggttgggaacctcatctcccaaatcaggggtgccagagcctgggcctgtggaacgtcccttcagtctgtcagtggggcaggagatgatccagtccaggccaggaagatcatcaagcagcctcagcgtgtgggagccggtcccatgaaaagggaaaatggcctccatcttgaaaccctgctggacccagttgatgactgcttttcagaagaggccccagatgccaccaagcacaagctgtcctccttcctgttcagttacttgtctgtgcagactaagaagaagacggtgcgctccctcagttgcaacagtgtgccagtgagtgctcagaagccactgcccacagaggcctctgtgaagaatgggggctcctccagggtcagaatcttttccaggtttccagaagacatgatgatgctgaagaaaagtgccttcaaaaaactcatcaaattctacagcgtccccagctttcctgaatgcagctctcaatgtggactccagctgccctgttgccctctgcaggccatggtttagacacagggccttcagccagagtctgaggatatacttcagggactctgtgaacccctcacaattgtatgccaactttgtgtgcttatgtgtacatgcatttttcttggggcgagttcataattttaatcaaattctcataggggttcatgacccacaataggatacaaacgaagagtttaagccagcatgatccagatgggttcagcagtctggtcagtgagaaagggccgagggtagacaggcagcttctgtggttcagcttgtgacatgatatataacacagaaataaattatgcttgtccctgaaacaaaaaaagtgcgcaggactggcaagagggaagccgggctgctccacgcctttcacgccttccacctcctgcgtgtccatctgtgagaaggagccagagcccaagggagatgatggagcctgaggagtacagagagagagggagagagatggtggattacatctgccagtacctgagcactgtgcgggagagacgtgtgacgccagacgtgcagcctggctacctgcgagcccagctgcctgagagtgctcctgaggaccccgacagctgggacagcatctttggggacattgaacgaatcatcatgcctggggtggtacattggcagagcccccatatgcacgcctactacccagccctcacctcttggccctccctgctaggagacatgctggctgatgccatcaactgcttgggattcacctgggcatccagccctgcgtgtacagagctggagatgaacgtcatggactggttggcaaaaatgctgggacttccagagcacttcttgcaccaccaccccagcagccagggcggaggcgtcctgcagcagacggtcagtgaatccactttgattgccctgctggcagcaaggaagaacaaaatcctggaaatgaaaacgtctgagcccgatgctgatgagtcctgcctaaatgcccgactcgtggcctatgcctctgaccaggctcactcctctgtggaaaaggctggtttgatttcccttgtgaagatgaaatttctgcctgtggatgacaacttctcactccgaggggaagctcttcagaaggccatcgaggaagacaagcagcggggcttggtgcccgtctttgtctgtgcaacactagggaccactggggtctgtgcatttgactgcctgtcagagctgggccccatctgtgcccgtgaggggctgtggctccacatcgatgctgcttatgcaggcactgccttcctgtgccccgagttccgggggtttctgaaggggattgagtatgccgactccttcacctttaatccttccaagtggatgatggtgcattttgactgtactgggttctgggtcaaggacaagtacaagctgcagcagaccttcagtgtgaatcccatctacctcaggcatgccaactcaggcgtggccaccgacttcatgcactggcagatccccctgagccgacggtttcgctctgttaaactctggttcgtgattcggtccttcggggtgaagaatcttcaagcacatgtcagacatggtactgaaatggctaaatattttgaatctctggtcagaaacgacccttcctttgaaattcctgccaagaggcaccttggcctggtggtttttcgtctaaagggtcctaattgtctcacagaaaatgtgttaaaggaaatagctaaagctggccgtctcttcctcatcccggccactatccaggacaagttaatcatccgtttcactgtgacatcccagtttaccactagggatgacatcctgagagactggaatctcattcgagatgctgccactctcatcctgagtcagcactgtacttcccaacccagccctcgggttgggaacctcatctcccaaatcaggggtgccagagcctgggcctgtggaacgtcccttcagtctgtcagtggggcaggagatgatccagtccaggccaggaagatcatcaagcagcctcagcgtgtgggagccggtcccatgaaaagggaaaatggcctccatcttgaaaccctgctggacccagttgatgactgcttttcagaagaggccccagatgccaccaagcacaagctgtcctccttcctgttcagttacttgtctgtgcagactaagaagaagacggtgcgctccctcagttgcaacagtgtgccagtgagtgctcagaagccactgcccacagaggcctctgtgaagaatgggggctcctccagggtcagaatcttttccaggtttccagaagacatgatgatgctgaagaaaagtgccttcaaaaaactcatcaaattctacagcgtccccagctttcctgaatgcagctctcaatgtggactccagctgccctgttgccctctgcaggccatggtttagacacagggccttcagcagagtctgaggatatacttcagggactctgtgaacccctcacaattgtatgccaactttgtgtgcttatgtgtacatgcatttttcttggggcgagttcataattttaatcaaattctcataggggctcatgacccacaataggatacaaacgaagagtttaagccagcatgatccagatgggttcatcagtctggtcagtgagaaagggccgagggtagacaggcagcttctgtggttcagcttgtgacatgatatataacacagaaataaattatgcttgtccctga

SEQ ID NO: 2879 - DNA, 1327 bp; single-stranded, linear
gatccccagagactttccagatatctgaagaagtcctgatgtcactgccccggtccttccccaggtagagcaacactcctcgtcgcaacccaactggctccccttaccttctacacacacacacacacacacacacacacacacacacacacacacaaatccaagacaacactactaaggcttctttgggagggggaagtagggataggtaagaggaaagtaagggacctcctatccagcctccatggaatcctgacttcttttccttgttatttcaacttcttccaccccatcttttaaactttagactccagccacagaagcttacaactaaaagaaactctaaggccaatttaatccaaggtttcattctatgtgctggagatggtgtacagtagggtgaggaaaccaaattctcagttggcactggtgtacccttgtacaggtgatgtaacatctctgtgcctcagtttgctcactataaaatagagacggtaggggtcatggtgagcactacctgactagcatataagaagctttcagcaagtgcagactactcttacccacttcccccaagcacagttggggtgggggacagctgaagaggtggaaacatgtgcctgagaatcctaatgaaatcggggtaaaggagcctggaacacatcctgtgaccccgcctgtcctgtaggaagccagtctctggaaagtaaaatggaagggctgcttgggaactttgaggatatttagcccaccccctcatttttacttggggaaactaaggcccagagacctaaggtgactgcctaagttagcaaggagaagtcttgggtattcatcccaggttggggggacccaattatttctcaatcccattgtattctggaatgggcaatttgtccacgtcactgtgacctaggaacacgcgaatgagaacccacagctgagggcctctgcgcacagaacagctgttctccccaggaaatcaactttttttaattgagaagctaaaaaattattctaagagaggtagcccatcctaaaaatagctgtaatgcagaagttcatgttcaaccaatcatttttgcttacgatgcaaaaattgaaaactaagtttattagagaggttagagaaggaggagctctaagcagaaaaaatcctgtgccgggaaaccttgattgtggctttttaatgaatgaagaggcctccctgagcttacaatataaaagggggacagagaggtgaaggtctacacatcaggggcttgctcttgcaaaaccaaaccacaagacagacttgcaaaagaaggcatgcacagctcagcactgc

SEQ ID NO: 2880 - DNA, 1601 bp; single-stranded, linear
aaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctcttatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaaataaaaataaaaataaatttggttctaatagaactcagttttaactagaatttattcaattcctctgggaatgttacattgtttgtctgtcttcatagcagattttaattttgaataaataaatgtatcttattcacatc

SEQ ID NO: 2881 - DNA, 4181 bp; single-stranded, linear
agatcttgtaaactgtagaatgcaccctccaaaatctatttgcataagcacacacacacacacacacacacacaccccagcagttcttgcctgcccagattcctctgcagctaaagtgatgaaacttactgggcggagcttcctaaaaagattattagggtctcctgggttggtgtgcctttaaacctttggactttaccacctcctatctctcctatctccttgcaacaaaggttaggagaacaagaatgcagaaaaaacgggtcctggatgacatctgagtgcctgctttgggcttcttgatgagtgagacagaaaataaaatacaaccccctcttttaaaagccatgcttactcaggttttccttcatttgcagctaaatacagaaatgagagaatattttggagcagggatggaagaagagaggtattccccttcccacaaccttctgatttcccagtacatcccccactggaaaaattcatttaaaatcagtataataagcattgattagatgcctactatgcatctgggcttgagggcaaactggactcaggccttttggcctcaagaagctcacagtgtgagagtggcatttgtgtcctcttgaaattcacaggactaaattgtgcccaggctgacattctatccatccataggtgcctgccttctcacttccctctcttcatgggctcttgccttgtaccaaaatccaaacccaaatctcctcacatgtgagtgttggcattcatgtctcagacatgacctatgggcttgggacttttccccgtggaccccagtgacttttcagatgaacaggtatcttcaaaaacttgagaaataggagtcctgtttgttgttcttgttgctttgtcaatataaggcacagggtctttattcaaatgttcatactatctcttgacagaaatactatgagacatattgatggagaagccgttatctccatatgctaaatgaggacttgcaccagggaacttgcccatggttctctccaaccacttaaattctgaaattttgaatgagagtggacagtaatttcaaatcaatggggaaagaatcaaatcttcagcaaatggcttgagataattagctacacatttcagaacaaataaagaagtcagatccgggccgggcacagtggctcatgcctgtaatctcagcactctgggaggccaaggcgggcggatcataaggtcaggagatcgagaccatcctggttaacacagtgaacccctctctaataaaaatacaaaaaaaaataaaaaaacttagccgggcgtggtgccaggcgcctgtagtcccagctactcgggacgctgaggcaggagaatggcttgaactcgggaggcagagcttgcaggtgagctgagatcatgccactgcactccagcctgggcaacagagcgagactctgtctcaaaaaaaaaaaagaagtcagatcctaacctcaaccctatttaacagattatagatgaaagaaaggtacaaatggcttttacatacctcccttctccctgacattttgtatgtgtgtgtgtgtgtatttacacacacatctcatataaggaaattgaagggaggctgcctgcatccctgagtcactctccctctccttctgaatgcttacctgtgcccagaccacctccttagcctcgcaccctccaggcttacagggcactcttctatgcccatcccaagtatagctgaaccttccaagggccagacttggtgctaagtaccaagtacgcaaagattaataaaacaatgtcctgtttcagggagctcaaagctgattcggcagggcatggtgtgtacatgaatgataaccacgtagggttgcaggtttcctagtgaggtaagcacaaggcaagatgggaaacaaaggaaggaggggttcacagcctcacccagagtccagaacccctggcctgcctggtgcccatgctgagtccacttctggaacacccagctcagagagggggttagacctgcaggctaacacagacacagcccagaaaacccaggagccgagggggaaggagaaaggtgcaagaaggggaaacccaggtcctggtccccttctctctgcttcctggcagcagaactcagacagaacccttaagccagtctaagtctggcaggaccagtaagttctgagttagctccatactagtttctagcaggctctttctcacttcctgattcttaggtttctacattgacactccctgaagagttgggaagagacaccacagtcccctgaccctgatccataggtcacacagcaggcatccacagggtgggcgtgggccctctcatccctccctcccactcacttcacgctggctgggccccaaggtgtttgcaccccttgcagtgagtgaccttctctagtgcagcaagctcagaacctgctgccactggagttgtcccattgctgatgcagaaaggtgaagaactagcagaacactggaaatgccctccatctgggtccatggctacttaatgctccctggcaggcaggaggacaggtgctattccctgttgggacagatgaaaaacagacacagggaggatgagtgatttgccctgactatagagtggcagggccaaggcagagcccaggcctcctgcacctaggtcagtgttcctcccagttacagtctaaactggaatgcaggcaaagcccctgtggaaggggaaggtgaaggctcaatcaaaggatccccagagactttccagatatctgaagaagtcctgatgtcactgccccggtccttccccaggtagagcaacactcctcgccgcaacccaactggctccccttaccttctacacacacacacacacacacacacacacacacacacacacacaaatccaagacaacactactaaggcttctttgggaaggggaagtagggataggtaagaggaaagtaagggacctcctatccagcctccatggaatcctgacttcttttccttgttatttcaacttcttccaccccatcttttaaactttagactccagccacagaagcttacaactaaaagaaactctaaggccaatttaatccaaggtttcattctatgtgctggagatggtgtacagtagggtgaggaaaccaaattctcagttggcactggtgtacccttgtacaggtgatgtaacatctctgtgcctcagtttgctcactataaaatagagacggtaggggtcatggtgagcactacctgactagcatataagaagctttcagcaagtgcagactactcttacccacttcccccaagcacagttggggtgggggacagctgaagaggtggaaacatgtgcctgagaatcctaatgaaatcggggtaaaggagcctggaacacatcctgtgaccccgcctgtcctgtaggaagccagtctctggaaagtaaaatggaagggctgcttgggaactttgaggatatttagcccaccccctcatttttacttggggaaactaaggcccagagacctaaggtgactgcctaagttagcaaggagaagtcttgggtattcatcccaggttggggggacccaattatttctcaatcccattgtattctggaatgggcaatttgtccacgtcactgtgacctaggaacacgcgaatgagaacccacagctgagggcctctgcgcacagaacagctgttctccccaggaaatcaactttttttaattgagaagctaaaaaattattctaagagaggtagcccatcctaaaaatagctgtaatgcagaagttcatgttcaaccaatcatttttgcttacgatgcaaaaattgaaaactaagtttattagagaggttagagaaggaggagctctaaggagaaaaaatcctgtgccgggaaaccttgattgtggctttttaatgaatgaagaggcctccctgagcttacaatataaaagggggacagagaggtgaaggtctacacatcaggggcttgctcttgcaaaaccaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatct

SEQ ID NO: 2882 - DNA, 1314 bp; single-stranded, linear
ggggggggggatttagagacttgctcttgcactaccaaagccacaaagcagccttgcagaaaagagagctccatcatgcctggctcagcactgctatgctgcctgctcttactgactggcatgaggatcagcaggggccagtacagccgggaagacaataactgcacccacttcccagtcggccagagccacatgctcctagagctgcggactgccttcagccaggtgaagactttctttcaaacaaaggaccagctggacaacatactgctaaccgactccttaatgcaggactttaagggttacttgggttgccaagccttatcggaaatgatccagttttacctggtagaagtgatgccccaggcagagaagcatggcccagaaatcaaggagcatttgaattccctgggtgagaagctgaagaccctcaggatgcggctgaggcgctgtcatcgatttctcccctgtgaaaataagagcaaggcagtggagcaggtgaagagtgattttaataagctccaagaccaaggtgtctacaaggccatgaatgaatttgacatcttcatcaactgcatagaagcatacatgatgatcaaaatgaaaagctaaaacacctgcagtgtgtattgagtctgctggactccaggacctagacagagctctctaaatctgatccagggatcttagctaacggaaacaactccttggaaaacctcgtttgtacctctctccgaaatatttattacctctgatacctcagttcccattctatttattcactgagcttctctgtgaactatttagaaagaagcccaatattataattttacagtatttattatttttaacctgtgtttaagctgtttccattggggacactttatagtatttaaagggagattatattatatgatgggaggggttcttccttgggaagcaattgaagcttctattctaaggctggccacacttgagagctgcagggccctttgctatggtgtcctttcaattgctctcatccctgagttcagagctcctaagagagttgtgaagaaactcatgggtcttgggaagagaaaccagggagatcctttgatgatcattcctgcagcagctcagagggttcccctactgtcatcccccagccgcttcatccctgaaaactgtggccagtttgttatttataaccacctaaaattagttctaatagaactcatttttaactagaagtaatgcaattcctctgggaatggtgtattgtttgtctgcctttgtagcagcatctaattttgaataaatggatcttattcg

SEQ ID NO: 2883 - DNA, 7207 bp; single-stranded, linear
cagtcaggagagagggcagtgagggtccatgctagctgggtcttgagcctcttctggggttcagtctctgatctacagcagtgtgtccacacctaaaacatcagctcagagaggcagttgcttctgctgttggaaacggacatcccaaaaaaaaacaaaaaacagaaatcaaaagggaaggagaaagtgaaagggatggaggcagcttgtccccttccctgtgcttgctgctggtagaaaactcagcctggaactgaccggagcagcagttcttgagtcaattccattccaacttctagaagattcttttcccgtcgaagagtgtcaggaggagaggccagacccccttgatcctgatctgccagccactgcatcagataagacgagataaccccgagttcctgttctaccagccctggtgtggtaaccctctccaatggggcaggcttggaaccctgtgccaacgaagatcctcccccgtactgatgcaggaaggacagcccgggagtgtaccctctacatgggtctacttttatttaagcaaacattccctggtcaacaggacgtgtagcattgcccccccccttgggtcacacagaaaacaggtaccaggaggacaagtagttgcttgcccagggtacagaatgaaaggcaataggggactctaggcgaatgttcttcccacccaaactgaggtagtaggagaagtccctactgaagggaaggtccagacataatcaaaggactaccagagatctcccaggtatctgtagaagtactaacatctccatccttcaacagctacaggttacacgtctccaaggctgggacattgtaaaacagggccatggtaaggtctacccgacagcacagagcaagcctcccagaagtctgagttccttctcctaacttctcatgctgggatctgagcttcttcgtgaaacacggggcagaggaggcaccagaactctcctctgaccaactgccccacagcacacatatcctcaaaggatagtcttgaatacgtgatggaagaattaaagagagtgaggtctgaagaaaatcagccctctcggggtttcctttgggtaactgagtgctaaggtgacttccgagtcagcaagaaatatcggacgttcaacccaggttgagtggaggaaacaattatttctcaatcctaatatgttctggaatagcccatttatccacgtcattatgacctgggagtgcgtgaatggaatccacagatgagggcctctgtacatagaacagctgtctgcctcaggaaatacaacttttagtattgagaagctaaaaagaaaaaaaaattaaaagagaggtagcccatactaaaaatagctgtaatgcagaagttcattccgaccagttctttagcgcttacaatgcaaaaaaaagggaaaggaaaaaaaaaaagaaagaaattaaactcaaaaattgcatggtttagaagagggaggaggagcctgaataacaaaaacctttgccaggaaggccccactgagccttcagtataaaagggggaccaagaacaggaggtctacatttagagacttgctcttgcactaccaaagccacaaggcagccttgcagaaaagagagctccatcatgcctggctcagcactgctatgctgcctgctcttactgactggcatgaggatcagcaggggccagtacagccgggaagacaataactgcacccacttcccagtcggccagagccacatgctcctagagctgcggactgccttcagccaggtgaagactttctttgtaagtatgagctcgcctagcctttcttcctgccatcacctgaaatatgcattctgatggaactgcaaaaatagctctccttctcctcctccttctcctccttctctttctcctcctctgctttctcctccttctcttcctcctccttctcttcttcctcctctccctcttcctcctccagctcttacctcatgctgctcctcccctatttccagcacctattacccttaaacttaaatctagagagtcctagggaaagccatgagttaaactaaacccaggcacatccgaaaagctaactaggaggtgaatgcattgtctctcccatgctcaagaactttctgttaagtttccaataaggctccatgttttgctggctaggacaaaagtctgtggtctctgcgtagtctctagatctgggggacagaggtttgggggtttgaagcagcaccagcatagagagcttgcattacaaaagtattcccctttcagagctcctggaactggtatggaggtccaaagaaggcagagagctatgcaaaacaggctttctataagggactccagaaaggaagggttgacacaggtgctcttgaaacctgatctgactcatctgaaagaagaccgggcctgggtctaacttctcccagtcagttaaattcagtcagaagtttttaaaaacaactggatcccaagaggaaggactttgatttaactccgggctctagcactgtcaaatcctgttcttaaaactctcctttccacagttgccagggcatttgaattgattacaaattcaaaactctacaaatggaaaagtattcaaatgacatgcacattgggtattttccccagtccttgcattcacgttctttatgttcttccagcaaacaaaggaccagctggacaacatactgctaaccgactccttaatgcaggactttaaggtaagagtccggtgggtgctggggagcgaccaagcgattagggacgggacgggaggtgctgcttgtgacagcagagctgggtctgatgccttgactttcaaaaagagaagtgagaagaccttgactcagcatatcgccagcagtcaagggttgtgaagagctcattctgtggtaaagggagaaaatgtaactagaaggggcggggatggggggggggtccctaggaacaggacagtccatcaaggttagcagcaacagatcaccattccagtaagtcacacccaacctctgatccctgcctctagggttacttgggttgccaagccttatcggaaatgatccagttttacctggtagaagtgatgccccaggcagagaagcatggcccagaaatcaaggagcatttgaattccctgggtgagaagctgaagaccctcaggatgcggctgaggcgctgtgtgagtagcagatgcgttcttccccacccccaatccccttagagccacccaacaaatactgtctcctacagcccagtcaggccacatgcatccagagacacacacagactagacaggagactaggtaaatctagagagacgcctgtccggtgtcgggtctcttgctcatctgtctctgagcgagtgtgggagtgactttgaggcactcacacgtgaagatttgcgcatagccttcctgttatttgtgagtcattgtgggttattagctactcccctctctctccatgggaaggctggggcttcagtcatggctccctcacctctgggctgccagctgaggctcccaagcacaggaaaacattcatctctttatctcatcttttgggaagcaaattcagtggcacagagctgggctgacaggacgctggtgtttcagaagggccagaagactgctatccctaagccagtatctatgaataatacagtcggggcatctatgtctctgaagcgatgccttggctgctcttgtttttcttacttctctcactgatactgggacatcagctggagtctacttgtgcaacggttctggcctgacgatttggccccagtagctgagactttcgctcctctctcagacacctagaaatagttcatggtggttgagattggagatagacaagaagagacactaaaaacagaacaggtgccttggagctctgagagacaaaacccgagacctgagttcacacccacacttagcaagccatcttagtgattgcaaagacatacattgcatctttctaggctgtcctctgctgtccccctcagtccctaccgaaatagataaggaccaatcacggctcagttctccctgggagctaagaagtgggcattgaagatgagcaagggtgtctccttcctcacacaacaagatagtttcccccaagtaccatggatgcagaattcaagcaagaattaccaatgctctcttttttcttcttcagcatcgatttctcccctgtgaaaataagagcaaggcagtggagcaggtgaagagtgattttaataaggtaagtggcaaagggggcgagtgtaacaagacctctgtctactcaccaaagcgcagaaggagggcgggagctattctgcacctggagtgtgggaacccagcaaatggtgtgacctcctctgccagttagaaagccaccacctcagttacatttgttttctgcaaagcgtctctggcagtttctaaatgactgctccacttttgcaggcttttggcttagactgaccagacagcctatgagcacagggcactaggtgttgaggagagtgacataggaaacagaaagtacagaaagtaccttgttgggaaacaggctgaacccacaagtacagaaagcagacatgaattaatttactcaggtacatcattggggctcagcctggatgcccctcccccaaatcagaacgagcagaaagcagaattcttacttgtcccggggcactttccacctggcaaacaaaatgaggtttcacacttccaactgcctgtgaacctattcaaccctagttcccagaagccatgtggcctacatcatcatctttgtgggctaggcagagacacctggcagggctctaacattagtgggcatgaattccatgacagcaggtcagagctgcagggtgaggactgcctacacactcaaaacataaaaaaaaaaaaaaaaaaacaccaaccatttccctgctatctctatcactgccctgcttacaaactgctccctctggcatctttgcataacattctgcataagcattatatgagcactggcctcttaaaaaaaattagttgaaaaggtgccaccctgaagacagtgctttggggactgaatgcttcccttgctgactcctggcagtgcttaaagctgggagaaggttggtcccaccacatcctgactactacagtatagttgtctctcttctttcatttccctgtccccatttctttattgtacataaagtaactggtgtatgtgcacacacatagtgctctctctttcttttccttttttaaactaaatggccgatgttctgttctggttggcatcagatggagatggtctgggggaaagtactgggtttgtgaaaatacccccttctccattagtggcatgctctttcagctcttatctttatattccagtaagttattttgctctcattgttttaacaaaagaacccaacaacaccaaatctttgcataccttgttcgattggagaattttaatgtttttcatttatcattgtaaaaccgaggacaattttataacttttttgtacgtggctgttacatgtagggcaatctgtctttaagtagggataaattactcttgaataaaatgatcctagatagttttcccttcaagtcaagcgtcttgttgtttaaataaacttcttgtttaaaatgaaaaaaaaaaaaacaaacaaacaaaaaaaagctgggagaaggtataggagaaacaggggaaggcacggccccttcccaaagcagacggacaaatctttgggtccttcagctcccaacacaagaaagcagagatctttctatgctcagcatccttcccagggcagggagcccctcagcccaccaatgggtactaaccagatgcttctctccccacacagctccaagaccaaggtgtctacaaggccatgaatgaatttgacatcttcatcaactgcatagaagcatacatgatgatcaaaatgaaaagctaaaacacctgcagtgtgtattgagtctgctggactccaggacctagacagagctctctaaatctgatccagggatcttagctaacggaaacaactccttggaaaacctcgtttgtacctctctccgaaatatttattacctctgatacctcagttcccattctatttattcactgagcttctctgtgaactatttagaaagaagcccaatattataattttacagtatttattatttttaacctgtgtttaagctgtttccattggggacactttatagtatttaaagggagattatattatatgatgggaggggttcttccttgggaagcaattgaagcttctattctaaggctggccacacttgagagctgcagggccctttgctatggtgtcctttcaattgctctcatccctgagttcagagctcctaagagagttgtgaagaaactcatgggtcttgggaagagaaaccagggagatcctttgatgatcattcctgcagcagctcagagggttcccctactgtcatcccccagccgcttcatccctgaaaactgtggccagtttgttatttataaccacctaaaattagttctaatagaactcatttttaactagaagtaatgcaattcctctgggaatggtgtattgtttgtctgcctttgtagcagactctaattttgaataaatggatcttattcgaattacagtgtggtgtctattgagttctgtctgatttaaaagaaaaatcccttaaaattccagagggcagaagcagtgaatcttagactccacaaaaagaatgccagcaacctctccaggaaggggttgagctcggatcagatcagaggaaagtcttgcctggctttcaaagcatcagcataaactactgatatcttcaagctcagtcctttaaaatgtgtcctgaaaccttaaaaggcattctaccttccaaagctagggaaggtgattctaagtaaccatcggaaggaagtgggaagcatcaaagctgaaactctgagacgaaatgttggggttaaaaatggaagctaggggcaggagggtggggagatggctcagcagttagagtgtgtgccggcaccagtgagacaggagttcatatccttggaatccaaccaacacacaaccaacactaggcaagagatgcctaatgtgtcagtggttgcttcaagctccagaggtcctggggtgaacttagatcc

SEQ ID NO: 2884 - DNA, 15630 bp; single-stranded, linear
gatccccagagactttccagatatctgaagaagtcctgatgtcactgccccggtccttccccaggtagagcaacactcctcgtcgcaacccaactggctccccttaccttctacacacacacacacacacacacacacacacacacacacacacacaaatccaagacaacactactaaggcttctttgggagggggaagtagggataggtaagaggaaagtaagggacctcctatccagcctccatggaatcctgacttcttttccttgttatttcaacttcttccaccccatcttttaaactttagactccagccacagaagcttacaactaaaagaaactctaaggccaatttaatccaaggtttcattctatgtgctggagatggtgtacagtagggtgaggaaaccaaattctcagttggcactggtgtacccttgtacaggtgatgtaacatctctgtgcctcagtttgctcactataaaatagagacggtaggggtcatggtgagcactacctgactagcatataagaagctttcagcaagtgcagactactcttacccacttcccccaagcacagttggggtgggggacagctgaagaggtggaaacatgtgcctgagaatcctaatgaaatcggggtaaaggagcctggaacacatcctgtgaccccgcctgtcctgtaggaagccagtctctggaaagtaaaatggaagggctgcttgggaactttgaggatatttagcccaccccctcatttttacttggggaaactaaggcccagagacctaaggtgactgcctaagttagcaaggagaagtcttgggtattcatcccaggttggggggacccaattatttctcaatcccattgtattctggaatgggcaatttgtccacgtcactgtgacctaggaacacgcgaatgagaacccacagctgagggcctctgcgcacagaacagctgttctccccaggaaatcaactttttttaattgagaagctaaaaaattattctaagagaggtagcccatcctaaaaatagctgtaatgcagaagttcatgttcaaccaatcatttttgcttacgatgcaaaaattgaaaactaagtttattagagaggttagagaaggaggagctctaagcagaaaaaatcctgtgccgggaaaccttgattgtggctttttaatgaatgaagaggcctccctgagcttacaatataaaagggggacagagaggtgaaggtctacacatcaggggcttgctcttgcaaaaccaaaccacaagacagacttgcaaaagaaggcatgcacagctcagcactgcaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctccgagatgccttcagcagagtgaagactttctttcaaatgaaggatcagctggacaacttgttgttaaaggagtccttgctggaggactttaagggttacctgggttgccaagccttgtctgagatgatccagttttacctggaggaggtgatgccccaagctgagaaccaagacccagacatcaaggcgcatgtgaactccctgggggagaacctgaagaccctcaggctgaggctacggcgctgtcatcgatttcttccctgtgaaaacaagagcaaggccgtggagcaggtgaagaatgcctttaataagctccaagagaaaggcatctacaaagccatgagtgagtttgacatcttcatcaactacatagaagcctacatgacaatgaagatacgaaactgagacatcagggtggcgactctatagactctaggacataaattagaggtctccaaaatcggatctggggctctgggatagctgacccagccccttgagaaaccttattgtacctctcttatagaatatttattacctctgatacctcaacccccatttctatttatttactgagcttctctgtgaacgatttagaaagaagcccaatattataatttttttcaatatttattattttcacctgtttttaagctgtttccatagggtgacacactatggtatttgagtgttttaagataaattataagttacataagggaggaaaaaaaatgttctttggggagccaacagaagcttccattccaagcctgaccacgctttctagctgttgagctgttttccctgacctccctctaatttatcttgtctctgggcttggggcttcctaactgctacaaatactcttaggaagagaaaccagggagcccctttgatgattaattcaccttccagtgtctcggagggattcccctaacctcattccccaaccacttcattcttgaaagctgtggccagcttgttatttataacaacctaaatttggttctaggccgggcgcggtggctcacgcctgtaatcccagcactttgggaggctgaggcgggtggatcacttgaggtcaggagttcctaaccagcctggtcaacatggtgaaaccccgtctctactaaaaatacaaaaattagccgggcatggtggcgcgcacctgtaatcccagctacttgggaggctgaggcaagagaattgcttgaacccaggagatggaagttgcagtgagctgatatcatgcccctgtactccagcctgggtgacagagcaagactctgtctcaaaaaaataaaaataaaaataaatttggttctaatagaactcagttttaactagaatttattcaattcctctgggaatgttacattgtttgtctgtcttcatagcagattttaattttgaataaataaatgtatcttattcacatcagatcttgtaaactgtagaatgcaccctccaaaatctatttgcataagcacacacacacacacacacacacacaccccagcagttcttgcctgcccagattcctctgcagctaaagtgatgaaacttactgggcggagcttcctaaaaagattattagggtctcctgggttggtgtgcctttaaacctttggactttaccacctcctatctctcctatctccttgcaacaaaggttaggagaacaagaatgcagaaaaaacgggtcctggatgacatctgagtgcctgctttgggcttcttgatgagtgagacagaaaataaaatacaaccccctcttttaaaagccatgcttactcaggttttccttcatttgcagctaaatacagaaatgagagaatattttggagcagggatggaagaagagaggtattccccttcccacaaccttctgatttcccagtacatcccccactggaaaaattcatttaaaatcagtataataagcattgattagatgcctactatgcatctgggcttgagggcaaactggactcaggccttttggcctcaagaagctcacagtgtgagagtggcatttgtgtcctcttgaaattcacaggactaaattgtgcccaggctgacattctatccatccataggtgcctgccttctcacttccctctcttcatgggctcttgccttgtaccaaaatccaaacccaaatctcctcacatgtgagtgttggcattcatgtctcagacatgacctatgggcttgggacttttccccgtggaccccagtgacttttcagatgaacaggtatcttcaaaaacttgagaaataggagtcctgtttgttgttcttgttgctttgtcaatataaggcacagggtctttattcaaatgttcatactatctcttgacagaaatactatgagacatattgatggagaagccgttatctccatatgctaaatgaggacttgcaccagggaacttgcccatggttctctccaaccacttaaattctgaaattttgaatgagagtggacagtaatttcaaatcaatggggaaagaatcaaatcttcagcaaatggcttgagataattagctacacatttcagaacaaataaagaagtcagatccgggccgggcacagtggctcatgcctgtaatctcagcactctgggaggccaaggcgggcggatcataaggtcaggagatcgagaccatcctggttaacacagtgaacccctctctaataaaaatacaaaaaaaaataaaaaaacttagccgggcgtggtgccaggcgcctgtagtcccagctactcgggacgctgaggcaggagaatggcttgaactcgggaggcagagcttgcaggtgagctgagatcatgccactgcactccagcctgggcaacagagcgagactctgtctcaaaaaaaaaaaagaagtcagatcctaacctcaaccctatttaacagattatagatgaaagaaaggtacaaatggcttttacatacctcccttctccctgacattttgtatgtgtgtgtgtgtgtatttacacacacatctcatataaggaaattgaagggaggctgcctgcatccctgagtcactctccctctccttctgaatgcttacctgtgcccagaccacctccttagcctcgcaccctccaggcttacagggcactcttctatgcccatcccaagtatagctgaaccttccaagggccagacttggtgctaagtaccaagtacgcaaagattaataaaacaatgtcctgtttcagggagctcaaagctgattcggcagggcatggtgtgtacatgaatgataaccacgtagggttgcaggtttcctagtgaggtaagcacaaggcaagatgggaaacaaaggaaggaggggttcacagcctcacccagagtccagaacccctggcctgcctggtgcccatgctgagtccacttctggaacacccagctcagagagggggttagacctgcaggctaacacagacacagcccagaaaacccaggagccgagggggaaggagaaaggtgcaagaaggggaaacccaggtcctggtccccttctctctgcttcctggcagcagaactcagacagaacccttaagccagtctaagtctggcaggaccagtaagttctgagttagctccatactagtttctagcaggctctttctcacttcctgattcttaggtttctacattgacactccctgaagagttgggaagagacaccacagtcccctgaccctgatccataggtcacacagcaggcatccacagggtgggcgtgggccctctcatccctccctcccactcacttcacgctggctgggccccaaggtgtttgcaccccttgcagtgagtgaccttctctagtgcagcaagctcagaacctgctgccactggagttgtcccattgctgatgcagaaaggtgaagaactagcagaacactggaaatgccctccatctgggtccatggctacttaatgctccctggcaggcaggaggacaggtgctattccctgttgggacagatgaaaaacagacacagggaggatgagtgatttgccctgactatagagtggcagggccaaggcagagcccaggcctcctgcacctaggtcagtgttcctcccagttacagtctaaactggaatgcaggcaaagcccctgtggaaggggaaggtgaaggctcaatcaaaggatccccagagactttccagatatctgaagaagtcctgatgtcactgccccggtccttccccaggtagagcaacactcctcgccgcaacccaactggctccccttaccttctacacacacacacacacacacacacacacacacacacacacacaaatccaagacaacactactaaggcttctttgggaaggggaagtagggataggtaagaggaaagtaagggacctcctatccagcctccatggaatcctgacttcttttccttgttatttcaacttcttccaccccatcttttaaactttagactccagccacagaagcttacaactaaaagaaactctaaggccaatttaatccaaggtttcattctatgtgctggagatggtgtacagtagggtgaggaaaccaaattctcagttggcactggtgtacccttgtacaggtgatgtaacatctctgtgcctcagtttgctcactataaaatagagacggtaggggtcatggtgagcactacctgactagcatataagaagctttcagcaagtgcagactactcttacccacttcccccaagcacagttggggtgggggacagctgaagaggtggaaacatgtgcctgagaatcctaatgaaatcggggtaaaggagcctggaacacatcctgtgaccccgcctgtcctgtaggaagccagtctctggaaagtaaaatggaagggctgcttgggaactttgaggatatttagcccaccccctcatttttacttggggaaactaaggcccagagacctaaggtgactgcctaagttagcaaggagaagtcttgggtattcatcccaggttggggggacccaattatttctcaatcccattgtattctggaatgggcaatttgtccacgtcactgtgacctaggaacacgcgaatgagaacccacagctgagggcctctgcgcacagaacagctgttctccccaggaaatcaactttttttaattgagaagctaaaaaattattctaagagaggtagcccatcctaaaaatagctgtaatgcagaagttcatgttcaaccaatcatttttgcttacgatgcaaaaattgaaaactaagtttattagagaggttagagaaggaggagctctaaggagaaaaaatcctgtgccgggaaaccttgattgtggctttttaatgaatgaagaggcctccctgagcttacaatataaaagggggacagagaggtgaaggtctacacatcaggggcttgctcttgcaaaaccaaaccacaagacagacttgcaaaagaaggcatgcacagctcagcactgctctgttgcctggtcctcctgactggggtgagggccagcccaggccagggcacccagtctgagaacagctgcacccacttcccaggcaacctgcctaacatgcttcgagatctggggggggggatttagagacttgctcttgcactaccaaagccacaaagcagccttgcagaaaagagagctccatcatgcctggctcagcactgctatgctgcctgctcttactgactggcatgaggatcagcaggggccagtacagccgggaagacaataactgcacccacttcccagtcggccagagccacatgctcctagagctgcggactgccttcagccaggtgaagactttctttcaaacaaaggaccagctggacaacatactgctaaccgactccttaatgcaggactttaagggttacttgggttgccaagccttatcggaaatgatccagttttacctggtagaagtgatgccccaggcagagaagcatggcccagaaatcaaggagcatttgaattccctgggtgagaagctgaagaccctcaggatgcggctgaggcgctgtcatcgatttctcccctgtgaaaataagagcaaggcagtggagcaggtgaagagtgattttaataagctccaagaccaaggtgtctacaaggccatgaatgaatttgacatcttcatcaactgcatagaagcatacatgatgatcaaaatgaaaagctaaaacacctgcagtgtgtattgagtctgctggactccaggacctagacagagctctctaaatctgatccagggatcttagctaacggaaacaactccttggaaaacctcgtttgtacctctctccgaaatatttattacctctgatacctcagttcccattctatttattcactgagcttctctgtgaactatttagaaagaagcccaatattataattttacagtatttattatttttaacctgtgtttaagctgtttccattggggacactttatagtatttaaagggagattatattatatgatgggaggggttcttccttgggaagcaattgaagcttctattctaaggctggccacacttgagagctgcagggccctttgctatggtgtcctttcaattgctctcatccctgagttcagagctcctaagagagttgtgaagaaactcatgggtcttgggaagagaaaccagggagatcctttgatgatcattcctgcagcagctcagagggttcccctactgtcatcccccagccgcttcatccctgaaaactgtggccagtttgttatttataaccacctaaaattagttctaatagaactcatttttaactagaagtaatgcaattcctctgggaatggtgtattgtttgtctgcctttgtagcagcatctaattttgaataaatggatcttattcgcagtcaggagagagggcagtgagggtccatgctagctgggtcttgagcctcttctggggttcagtctctgatctacagcagtgtgtccacacctaaaacatcagctcagagaggcagttgcttctgctgttggaaacggacatcccaaaaaaaaacaaaaaacagaaatcaaaagggaaggagaaagtgaaagggatggaggcagcttgtccccttccctgtgcttgctgctggtagaaaactcagcctggaactgaccggagcagcagttcttgagtcaattccattccaacttctagaagattcttttcccgtcgaagagtgtcaggaggagaggccagacccccttgatcctgatctgccagccactgcatcagataagacgagataaccccgagttcctgttctaccagccctggtgtggtaaccctctccaatggggcaggcttggaaccctgtgccaacgaagatcctcccccgtactgatgcaggaaggacagcccgggagtgtaccctctacatgggtctacttttatttaagcaaacattccctggtcaacaggacgtgtagcattgcccccccccttgggtcacacagaaaacaggtaccaggaggacaagtagttgcttgcccagggtacagaatgaaaggcaataggggactctaggcgaatgttcttcccacccaaactgaggtagtaggagaagtccctactgaagggaaggtccagacataatcaaaggactaccagagatctcccaggtatctgtagaagtactaacatctccatccttcaacagctacaggttacacgtctccaaggctgggacattgtaaaacagggccatggtaaggtctacccgacagcacagagcaagcctcccagaagtctgagttccttctcctaacttctcatgctgggatctgagcttcttcgtgaaacacggggcagaggaggcaccagaactctcctctgaccaactgccccacagcacacatatcctcaaaggatagtcttgaatacgtgatggaagaattaaagagagtgaggtctgaagaaaatcagccctctcggggtttcctttgggtaactgagtgctaaggtgacttccgagtcagcaagaaatatcggacgttcaacccaggttgagtggaggaaacaattatttctcaatcctaatatgttctggaatagcccatttatccacgtcattatgacctgggagtgcgtgaatggaatccacagatgagggcctctgtacatagaacagctgtctgcctcaggaaatacaacttttagtattgagaagctaaaaagaaaaaaaaattaaaagagaggtagcccatactaaaaatagctgtaatgcagaagttcattccgaccagttctttagcgcttacaatgcaaaaaaaagggaaaggaaaaaaaaaaagaaagaaattaaactcaaaaattgcatggtttagaagagggaggaggagcctgaataacaaaaacctttgccaggaaggccccactgagccttcagtataaaagggggaccaagaacaggaggtctacatttagagacttgctcttgcactaccaaagccacaaggcagccttgcagaaaagagagctccatcatgcctggctcagcactgctatgctgcctgctcttactgactggcatgaggatcagcaggggccagtacagccgggaagacaataactgcacccacttcccagtcggccagagccacatgctcctagagctgcggactgccttcagccaggtgaagactttctttgtaagtatgagctcgcctagcctttcttcctgccatcacctgaaatatgcattctgatggaactgcaaaaatagctctccttctcctcctccttctcctccttctctttctcctcctctgctttctcctccttctcttcctcctccttctcttcttcctcctctccctcttcctcctccagctcttacctcatgctgctcctcccctatttccagcacctattacccttaaacttaaatctagagagtcctagggaaagccatgagttaaactaaacccaggcacatccgaaaagctaactaggaggtgaatgcattgtctctcccatgctcaagaactttctgttaagtttccaataaggctccatgttttgctggctaggacaaaagtctgtggtctctgcgtagtctctagatctgggggacagaggtttgggggtttgaagcagcaccagcatagagagcttgcattacaaaagtattcccctttcagagctcctggaactggtatggaggtccaaagaaggcagagagctatgcaaaacaggctttctataagggactccagaaaggaagggttgacacaggtgctcttgaaacctgatctgactcatctgaaagaagaccgggcctgggtctaacttctcccagtcagttaaattcagtcagaagtttttaaaaacaactggatcccaagaggaaggactttgatttaactccgggctctagcactgtcaaatcctgttcttaaaactctcctttccacagttgccagggcatttgaattgattacaaattcaaaactctacaaatggaaaagtattcaaatgacatgcacattgggtattttccccagtccttgcattcacgttctttatgttcttccagcaaacaaaggaccagctggacaacatactgctaaccgactccttaatgcaggactttaaggtaagagtccggtgggtgctggggagcgaccaagcgattagggacgggacgggaggtgctgcttgtgacagcagagctgggtctgatgccttgactttcaaaaagagaagtgagaagaccttgactcagcatatcgccagcagtcaagggttgtgaagagctcattctgtggtaaagggagaaaatgtaactagaaggggcggggatggggggggggtccctaggaacaggacagtccatcaaggttagcagcaacagatcaccattccagtaagtcacacccaacctctgatccctgcctctagggttacttgggttgccaagccttatcggaaatgatccagttttacctggtagaagtgatgccccaggcagagaagcatggcccagaaatcaaggagcatttgaattccctgggtgagaagctgaagaccctcaggatgcggctgaggcgctgtgtgagtagcagatgcgttcttccccacccccaatccccttagagccacccaacaaatactgtctcctacagcccagtcaggccacatgcatccagagacacacacagactagacaggagactaggtaaatctagagagacgcctgtccggtgtcgggtctcttgctcatctgtctctgagcgagtgtgggagtgactttgaggcactcacacgtgaagatttgcgcatagccttcctgttatttgtgagtcattgtgggttattagctactcccctctctctccatgggaaggctggggcttcagtcatggctccctcacctctgggctgccagctgaggctcccaagcacaggaaaacattcatctctttatctcatcttttgggaagcaaattcagtggcacagagctgggctgacaggacgctggtgtttcagaagggccagaagactgctatccctaagccagtatctatgaataatacagtcggggcatctatgtctctgaagcgatgccttggctgctcttgtttttcttacttctctcactgatactgggacatcagctggagtctacttgtgcaacggttctggcctgacgatttggccccagtagctgagactttcgctcctctctcagacacctagaaatagttcatggtggttgagattggagatagacaagaagagacactaaaaacagaacaggtgccttggagctctgagagacaaaacccgagacctgagttcacacccacacttagcaagccatcttagtgattgcaaagacatacattgcatctttctaggctgtcctctgctgtccccctcagtccctaccgaaatagataaggaccaatcacggctcagttctccctgggagctaagaagtgggcattgaagatgagcaagggtgtctccttcctcacacaacaagatagtttcccccaagtaccatggatgcagaattcaagcaagaattaccaatgctctcttttttcttcttcagcatcgatttctcccctgtgaaaataagagcaaggcagtggagcaggtgaagagtgattttaataaggtaagtggcaaagggggcgagtgtaacaagacctctgtctactcaccaaagcgcagaaggagggcgggagctattctgcacctggagtgtgggaacccagcaaatggtgtgacctcctctgccagttagaaagccaccacctcagttacatttgttttctgcaaagcgtctctggcagtttctaaatgactgctccacttttgcaggcttttggcttagactgaccagacagcctatgagcacagggcactaggtgttgaggagagtgacataggaaacagaaagtacagaaagtaccttgttgggaaacaggctgaacccacaagtacagaaagcagacatgaattaatttactcaggtacatcattggggctcagcctggatgcccctcccccaaatcagaacgagcagaaagcagaattcttacttgtcccggggcactttccacctggcaaacaaaatgaggtttcacacttccaactgcctgtgaacctattcaaccctagttcccagaagccatgtggcctacatcatcatctttgtgggctaggcagagacacctggcagggctctaacattagtgggcatgaattccatgacagcaggtcagagctgcagggtgaggactgcctacacactcaaaacataaaaaaaaaaaaaaaaaaacaccaaccatttccctgctatctctatcactgccctgcttacaaactgctccctctggcatctttgcataacattctgcataagcattatatgagcactggcctcttaaaaaaaattagttgaaaaggtgccaccctgaagacagtgctttggggactgaatgcttcccttgctgactcctggcagtgcttaaagctgggagaaggttggtcccaccacatcctgactactacagtatagttgtctctcttctttcatttccctgtccccatttctttattgtacataaagtaactggtgtatgtgcacacacatagtgctctctctttcttttccttttttaaactaaatggccgatgttctgttctggttggcatcagatggagatggtctgggggaaagtactgggtttgtgaaaatacccccttctccattagtggcatgctctttcagctcttatctttatattccagtaagttattttgctctcattgttttaacaaaagaacccaacaacaccaaatctttgcataccttgttcgattggagaattttaatgtttttcatttatcattgtaaaaccgaggacaattttataacttttttgtacgtggctgttacatgtagggcaatctgtctttaagtagggataaattactcttgaataaaatgatcctagatagttttcccttcaagtcaagcgtcttgttgtttaaataaacttcttgtttaaaatgaaaaaaaaaaaaacaaacaaacaaaaaaaagctgggagaaggtataggagaaacaggggaaggcacggccccttcccaaagcagacggacaaatctttgggtccttcagctcccaacacaagaaagcagagatctttctatgctcagcatccttcccagggcagggagcccctcagcccaccaatgggtactaaccagatgcttctctccccacacagctccaagaccaaggtgtctacaaggccatgaatgaatttgacatcttcatcaactgcatagaagcatacatgatgatcaaaatgaaaagctaaaacacctgcagtgtgtattgagtctgctggactccaggacctagacagagctctctaaatctgatccagggatcttagctaacggaaacaactccttggaaaacctcgtttgtacctctctccgaaatatttattacctctgatacctcagttcccattctatttattcactgagcttctctgtgaactatttagaaagaagcccaatattataattttacagtatttattatttttaacctgtgtttaagctgtttccattggggacactttatagtatttaaagggagattatattatatgatgggaggggttcttccttgggaagcaattgaagcttctattctaaggctggccacacttgagagctgcagggccctttgctatggtgtcctttcaattgctctcatccctgagttcagagctcctaagagagttgtgaagaaactcatgggtcttgggaagagaaaccagggagatcctttgatgatcattcctgcagcagctcagagggttcccctactgtcatcccccagccgcttcatccctgaaaactgtggccagtttgttatttataaccacctaaaattagttctaatagaactcatttttaactagaagtaatgcaattcctctgggaatggtgtattgtttgtctgcctttgtagcagactctaattttgaataaatggatcttattcgaattacagtgtggtgtctattgagttctgtctgatttaaaagaaaaatcccttaaaattccagagggcagaagcagtgaatcttagactccacaaaaagaatgccagcaacctctccaggaaggggttgagctcggatcagatcagaggaaagtcttgcctggctttcaaagcatcagcataaactactgatatcttcaagctcagtcctttaaaatgtgtcctgaaaccttaaaaggcattctaccttccaaagctagggaaggtgattctaagtaaccatcggaaggaagtgggaagcatcaaagctgaaactctgagacgaaatgttggggttaaaaatggaagctaggggcaggagggtggggagatggctcagcagttagagtgtgtgccggcaccagtgagacaggagttcatatccttggaatccaaccaacacacaaccaacactaggcaagagatgcctaatgtgtcagtggttgcttcaagctccagaggtcctggggtgaacttagatcc

SEQ ID NO: 2885 - DNA, 3632 bp; single-stranded, linear
aaagagctggaggcgcgcaggccggctccgctccggccccggacgatgcggcgcgcccaggatgctgccgtgcctcgtagtgctgctggcggcgctcctcagcctccgtcttggctcagacgctcatgggacagagctgcccagccctccgtctgtgtggtttgaagcagaatttttccaccacatcctccactggacacccatcccaaatcagtctgaaagtacctgctatgaagtggcgctcctgaggtatggaatagagtcctggaactccatctccaactgtagccagaccctgtcctatgaccttaccgcagtgaccttggacctgtaccacagcaatggctaccgggccagagtgcgggctgtggacggcagccggcactccaactggaccgtcaccaacacccgcttctctgtggatgaagtgactctgacagttggcagtgtgaacctagagatccacaatggcttcatcctcgggaagattcagctacccaggcccaagatggcccccgcgaatgacacatatgaaagcatcttcagtcacttccgagagtatgagattgccattcgcaaggtgccgggaaacttcacgttcacacacaagaaagtaaaacatgaaaacttcagcctcctaacctctggagaagtgggagagttctgtgtccaggtgaaaccatctgtcgcttcccgaagtaacaaggggatgtggtctaaagaggagtgcatctccctcaccaggcagtatttcaccgtgaccaacgtcatcatcttctttgcctttgtcctgctgctctccggagccctcgcctactgcctggccctccagctgtatgtgcggcgccgaaagaagctacccagtgtcctgctcttcaagaagcccagccccttcatcttcatcagccagcgtccctccccagagacccaagacaccatccacccgcttgatgaggaggcctttttgaaggtgtccccagagctgaagaacttggacctgcacggcagcacagacagtggctttggcagcaccaagccatccctgcagactgaagagccccagttcctcctccctgaccctcacccccaggctgacagaacgctgggaaacggggagccccctgtgctgggggacagctgcagtagtggcagcagcaatagcacagacagcgggatctgcctgcaggagcccagcctgagccccagcacagggcccacctgggagcaacaggtggggagcaacagcaggggccaggatgacagtggcattgacttagttcaaaactctgagggccgggctggggacacacagggtggctcggccttgggccaccacagtcccccggagcctgaggtgcctggggaagaagacccagctgctgtggcattccagggttacctgaggcagaccagatgtgctgaagagaaggcaaccaagacaggctgcctggaggaagaatcgcccttgacagatggccttggccccaaattcgggagatgcctggttgatgaggcaggcttgcatccaccagccctggccaagggctatttgaaacaggatcctctagaaatgactctggcttcctcaggggccccaacgggacagtggaaccagcccactgaggaatggtcactcctggccttgagcagctgcagtgacctgggaatatctgactggagctttgcccatgaccttgcccctctaggctgtgtggcagccccaggtggtctcctgggcagctttaactcagacctggtcaccctgcccctcatctctagcctgcagtcaagtgagtgactcgggctgagaggctgcttttgattttagccatgcctgctcctctgcctggaccaggaggagggccctggggcagaagttaggcacgaggcagtctgggcacttttctgcaagtccactggggctggcccagccaggctgcagggctggtcagggtgtctggggcaggaggaggccaactcactgaactagtgcagggtatgtgggtggcactgacctgttctgttgactggggccctgcagactctggcagagctgagaagggcagggaccttctccctcctaggaactctttcctgtatcataaaggattatttgctcaggggaaccatggggctttctggagttgtggtgaggccaccaggctgaagtcagctcagacccagacctccctgcttaggccactcgagcatcagagcttccagcaggaggaagggctgtaggaatggaagcttcagggccttgctgctggggtcatttttaggggaaaaaggaggatatgatggtcacatggggaacctcccctcatcgggcctctggggcaggaagcttgtcactggaagatcttaaggtatatattttctggacactcaaacacatcataatggattcactgaggggagacaaagggagccgagaccctggatggggcttccagctcagaacccatccctctggtgggtacctctggcacccatctgcaaatatctccctctctccaacaaatggagtagcatccccctggggcacttgctgaggccaagccactcacatcctcactttgctgccccaccatcttgctgacaacttccagagaagccatggttttttgtattggtcataactcagccctttgggcggcctctgggcttgggcaccagctcatgccagccccagagggtcagggttggaggcctgtgcttgtgtttgctgctaatgtccagctacagacccagaggataagccactgggcactgggctggggtccctgccttgttggtgttcagctgtgtgattttggactagccacttgtcagagggcctcaatctcccatctgtgaaataaggactccacctttaggggaccctccatgtttgctgggtattagccaagctggtcctgggagaatgcagatactgtccgtggactaccaagctggcttgtttcttatgccagaggctaacagatccaatgggagtccatggtgtcatgccaagacagtatcagacacagccccagaagggggcattatgggccctgcctccccataggccatttggactctgccttcaaacaaaggcagttcagtccacaggcatggaagctgtgaggggacaggcctgtgcgtgccatccagagtcatctcagccctgcctttctctggagcattctgaaaacagatattctggcccagggaatccagccatgacccccacccctctgccaaagtactcttaggtgccagtctggtaactgaactccctctggaggcaggcttgagggaggattcctcagggttcccttgaaagctttatttatttattttgttcatttatttattggagaggcagcattgcacagtgaaagaattctggatatctcaggagccccgaaattctagctctgactttgctgtttccagtggtatgaccttggagaagtcacttatcctcttggagcctcagtttcctcatctgcagaataatgactgacttgtctaattcatagggatgtgaggttctgctgaggaaatgggtatgaatgtgccttgaacacaaagctctgtcaataagtgatacatgttttttattccaataaattgtcaagaccaca

SEQ ID NO: 2886 - DNA, 1696 bp; single-stranded, linear; identical to SEQ ID NO: 2524

SEQ ID NO: 2887 - DNA, 1682 bp; single-stranded, linear; identical to SEQ ID NO: 2525

SEQ ID NO: 2888 - DNA, 413 bp; single-stranded, linear; identical to SEQ ID NO: 2526

SEQ ID NO: 2889 - DNA, 3791 bp; single-stranded, linear; identical to SEQ ID NO: 2527

SEQ ID NO: 2890 - DNA, 762 bp; single-stranded, linear
atgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaa

SEQ ID NO: 2891 - DNA, 2056 bp; single-stranded, linear
aagcttcttttgcataactggcgctggatttttactgagactttacgttacagttttttttttttaaatttcaaggtgcttttacgaacacatgaataaaatatttgtgtcattttgaaccttacttgtcttattttatgcatgtatttatttatgggggggcacaaggactcatctgtggtggtgcagccactgtaaataaattagtgaaactacttcacgtcaatttctgttcagtacactttagtgatggatcggaggaaattaatacatgtttacaaaaagcccctcccccagttgttacatatgcctcagagataccagttgtgaaaagtgcaggtgcacttacacacatacgcacacacaccccacaaatggtatcatacgaaaaaacatacctgcaatctgatttgtccacttaattgtatatcttggatacagaacttgtttcactggaaggctaaaaggcaaagtctggggaggcctagaggacacaggggatgggaggaggcgctctgagctggatgtaaggtctccacccacggccagagcacaaggtcggataaccagtgggcctgccggcttggctgcctgggccctcccctgccgagacaaacggctggagggaggaagtgtgcggctgggaagctccgctgctctggcccgggtttcccatttcccccttcccgcgctgagacggcgaggaaagttagcccggaaatctgcgcccgcctaaaacccggcctggtcccagccaccgccccaggaacttcccccaccgcaggggcggaggtcgagagcagggatggagaagtggacctgcgcgggtggactccggggcgcgggtggactccggggcgcggggggactccgaggagcgggtggactgtggggcgcgggtaccgtctcgcagcgacctctgtcggcggctctggggatggcccgcatctgtctgcgtgtacctggtatacgtgcaggtacatgttcctgttcacgtgcagactgggcgggggatgggggggtccacaccggtgtacacctttgcatacctcttagcaacttgaaattccaccacgagagatatctttattccgctattcctgtgcatctgcacggagcccctagggccatagatttgtgtgcaaatgaaatgaggatgtagtctgggtgcccaagggggggtgccttgagtgtggttgtctgtatgcctccctgagggtatttcactttctgctcccatccgcccctatgagcgagtacctatgagcacaggatgtgcacatatttgagtcttattagtggtacacgcagttttatcatctccccaggtctgtgtctgtatgaaatgtgcatgggtgtgtgtgtgcacgcgtgtgttcccactcggggaatgtggggagaggtgcatggagccaagatgggtggtaaatagtatgtttctgaaattaaaggactaatgtggaggaaggcgccccagatgtactaaaccctttgccttcatctcatcctctctgacttgggaagaaccaggattttgtttttaagcccttgggcatacagttgttccatcccgacatgaactcagcctcccgtctgaccgccccttggccttccttcttcctcgatctgtggaacccagggaatctgcctagtgctgtctccaagcaccttggccatgatgtaaacccagagaaattagcatctccatctccttccttattccccacccaaaagtcatttcctcttagttcattacctgggattttgatgtctatgttccctcctcgttattgatacacacacagagagagacaaacaaaaaaggaacttcttgaaattcccccagaaggttttgagagttgttttcaatgttgcaacaagtcagtttctagtttaagtttccatcagaaaggagtagagtatataagttccagtaccagcaacagcagcagaagaaacaacatctgtttcagggccattggactctccgtcctgcccagagcaaggtaagcacttcccaagcccctacctccctcccctccctgtgggcctgcag

SEQ ID NO: 2892 - DNA, 1703 bp; single-stranded, linear
gaattctcagacagcagcattagaaggggccttagagatcaaccatttctcttattttacacacacctaaaactccctacagccgtgcttcatcagcttcgagcagatgagccacccagaaggcagctccagttattaggtcctagggcctgggtgtagtcaggccctttggaagctccaagtcagagatcaaacacatcctccccactacccacgcctagggtgactaatgcctgtgggaaaaacaactgaactaaaaagtcccacaggaacctcaaacccagcacatccaaaatggaacttctcaccatctcctccaaactcagtcctcttatacagtaatccctgtaaagctagaacaatctccattccccattctcagggccttcctctcccgctcacctgaggagctaccaagccttggcccacaagccctctgagagtccctcctgcccaccctgtgttctccatactgaataaggacttggccacaccttgtcaactcttccctctgctctactcctgacccctggatccccccatcatgcaaattctgccacatctcccgcctaaaacccaggaagactccccactactctcagcacagaaagtacactccttagtatggcatcccctgccctcatggcatggcccatccagccctccagcctcacaccctgcaaggacacctagacccccacctccctcaacccttcatgactgcgcttctgatccctgtttcccctggctagaccctgcgtgccctcccgctggaagcggtctaatgcctgcttgtttttaacactcaggttggggcccctgcctgctcccgggagcctttgctgactcctggaccccgttgctccggctgagcgtgggctctttctctaggtctttcctcccaggactctgtgtattcatcctatcgttaaactggattctctacaagagtaataattgcagagtcagccagctctcatcccttttcaggtttcagaaaagacctgtgaacaaaacgccttgagtctgatttagtgtggcaatgccccaagggtcctgttctccctgggtgtcctgcacctggtgcaacgtcggcctggcatctagtgagccatctaaaggaacgatgatgagtgaatgatttgcctaccccttccagtactaggctggaggtcgtggttagggcccatccctacgcaggacatgcaaagtgggaggcactcctctctctacgtcggcagggggcgctgcacagctgcggggcggggtagcttagacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagcccccggggccggccgcaccgcacgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgca

SEQ ID NO: 2893 - DNA, 4521 bp; single-stranded, linear
atgtggccccctgggtcagcctcccagccaccgccctcacctgccgcggccacaggtctgcatccagcggctcgccctgtgtccctgcagtgccggctcagcatgtgtccagcgcgcagcctcctccttgtggctaccctggtcctcctggaccacctcagtttggccagaaacctccccgtggccactccagacccaggaatgttcccatgccttcaccactcccaaaacctgctgagggccgtcagcaacatgctccagaaggccagacaaactctagaattttacccttgcacttctgaagagattgatcatgaagatatcacaaaagataaaaccagcacagtggaggcctgtttaccattggaattaaccaagaatgagagttgcctaaattccagagagacctctttcataactaatgggagttgcctggcctccagaaagacctcttttatgatggccctgtgccttagtagtatttatgaagacttgaagatgtaccaggtggagttcaagaccatgaatgcaaagcttctgatggatcctaagaggcagatctttctagatcaaaacatgctggcagttattgatgagctgatgcaggccctgaatttcaacagtgagactgtgccacaaaaatcctcccttgaagaaccggatttttataaaactaaaatcaagctctgcatacttcttcatgctttcagaattcgggcagtgactattgatagagtgatgagctatctgaatgcttcctaaaagcttcttttgcataactggcgctggatttttactgagactttacgttacagttttttttttttaaatttcaaggtgcttttacgaacacatgaataaaatatttgtgtcattttgaaccttacttgtcttattttatgcatgtatttatttatgggggggcacaaggactcatctgtggtggtgcagccactgtaaataaattagtgaaactacttcacgtcaatttctgttcagtacactttagtgatggatcggaggaaattaatacatgtttacaaaaagcccctcccccagttgttacatatgcctcagagataccagttgtgaaaagtgcaggtgcacttacacacatacgcacacacaccccacaaatggtatcatacgaaaaaacatacctgcaatctgatttgtccacttaattgtatatcttggatacagaacttgtttcactggaaggctaaaaggcaaagtctggggaggcctagaggacacaggggatgggaggaggcgctctgagctggatgtaaggtctccacccacggccagagcacaaggtcggataaccagtgggcctgccggcttggctgcctgggccctcccctgccgagacaaacggctggagggaggaagtgtgcggctgggaagctccgctgctctggcccgggtttcccatttcccccttcccgcgctgagacggcgaggaaagttagcccggaaatctgcgcccgcctaaaacccggcctggtcccagccaccgccccaggaacttcccccaccgcaggggcggaggtcgagagcagggatggagaagtggacctgcgcgggtggactccggggcgcgggtggactccggggcgcggggggactccgaggagcgggtggactgtggggcgcgggtaccgtctcgcagcgacctctgtcggcggctctggggatggcccgcatctgtctgcgtgtacctggtatacgtgcaggtacatgttcctgttcacgtgcagactgggcgggggatgggggggtccacaccggtgtacacctttgcatacctcttagcaacttgaaattccaccacgagagatatctttattccgctattcctgtgcatctgcacggagcccctagggccatagatttgtgtgcaaatgaaatgaggatgtagtctgggtgcccaagggggggtgccttgagtgtggttgtctgtatgcctccctgagggtatttcactttctgctcccatccgcccctatgagcgagtacctatgagcacaggatgtgcacatatttgagtcttattagtggtacacgcagttttatcatctccccaggtctgtgtctgtatgaaatgtgcatgggtgtgtgtgtgcacgcgtgtgttcccactcggggaatgtggggagaggtgcatggagccaagatgggtggtaaatagtatgtttctgaaattaaaggactaatgtggaggaaggcgccccagatgtactaaaccctttgccttcatctcatcctctctgacttgggaagaaccaggattttgtttttaagcccttgggcatacagttgttccatcccgacatgaactcagcctcccgtctgaccgccccttggccttccttcttcctcgatctgtggaacccagggaatctgcctagtgctgtctccaagcaccttggccatgatgtaaacccagagaaattagcatctccatctccttccttattccccacccaaaagtcatttcctcttagttcattacctgggattttgatgtctatgttccctcctcgttattgatacacacacagagagagacaaacaaaaaaggaacttcttgaaattcccccagaaggttttgagagttgttttcaatgttgcaacaagtcagtttctagtttaagtttccatcagaaaggagtagagtatataagttccagtaccagcaacagcagcagaagaaacaacatctgtttcagggccattggactctccgtcctgcccagagcaaggtaagcacttcccaagcccctacctccctcccctccctgtgggcctgcaggaattctcagacagcagcattagaaggggccttagagatcaaccatttctcttattttacacacacctaaaactccctacagccgtgcttcatcagcttcgagcagatgagccacccagaaggcagctccagttattaggtcctagggcctgggtgtagtcaggccctttggaagctccaagtcagagatcaaacacatcctccccactacccacgcctagggtgactaatgcctgtgggaaaaacaactgaactaaaaagtcccacaggaacctcaaacccagcacatccaaaatggaacttctcaccatctcctccaaactcagtcctcttatacagtaatccctgtaaagctagaacaatctccattccccattctcagggccttcctctcccgctcacctgaggagctaccaagccttggcccacaagccctctgagagtccctcctgcccaccctgtgttctccatactgaataaggacttggccacaccttgtcaactcttccctctgctctactcctgacccctggatccccccatcatgcaaattctgccacatctcccgcctaaaacccaggaagactccccactactctcagcacagaaagtacactccttagtatggcatcccctgccctcatggcatggcccatccagccctccagcctcacaccctgcaaggacacctagacccccacctccctcaacccttcatgactgcgcttctgatccctgtttcccctggctagaccctgcgtgccctcccgctggaagcggtctaatgcctgcttgtttttaacactcaggttggggcccctgcctgctcccgggagcctttgctgactcctggaccccgttgctccggctgagcgtgggctctttctctaggtctttcctcccaggactctgtgtattcatcctatcgttaaactggattctctacaagagtaataattgcagagtcagccagctctcatcccttttcaggtttcagaaaagacctgtgaacaaaacgccttgagtctgatttagtgtggcaatgccccaagggtcctgttctccctgggtgtcctgcacctggtgcaacgtcggcctggcatctagtgagccatctaaaggaacgatgatgagtgaatgatttgcctaccccttccagtactaggctggaggtcgtggttagggcccatccctacgcaggacatgcaaagtgggaggcactcctctctctacgtcggcagggggcgctgcacagctgcggggcggggtagcttagacacggggcgtccggctaaggccggggacccagggtggtgggcggggtgtcccgcccgcctgtggaccccgcgcagtaactgcgaacatttcgctttcattttgggccgagctggaggcggcggggccgtcccggaacggctgcggccgggcaccccgggagttaatccgaaagcgccgcaagcccccggggccggccgcaccgcacgtgtcaccgagaagctgatgtagagagagacacagaaggagacagaaagcaagagaccagagtcccgggaaagtcctgccgcgcctcgggacaattataaaaatgtggccccctgggtcagcctcccagccaccgccctcacctgccgcggccacaggtctgcatccagcggctcgccctgtgtccctgcagtgccggctcagcatgtgtccagcgcgca

SEQ ID NO: 2894 - DNA, 1742 bp; single-stranded, linear
caagcccagagccctgccatttctgtgggctcaggtccctactgctcagccccttcctccctcggcaaggccacaatgaaccggggagtcccttttaggcacttgcttctggtgctgcaactggcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtccatccaagctgaatgatcgcgctgactcaagaagaagcctttgggaccaaggaaacttccccctgatcatcaagaatcttaagatagaagactcagatacttacatctgtgaagtggaggaccagaaggaggaggtgcaattgctagtgttcggattgactgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagcttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagagactcctcagtgagaagaagacctgccagtgccctcaccggtttcagaagacatgtagccccatttgaggcacgaggccaggcagatcccacttgcagcctccccaggtgtctgccccgcgtttcctgcctgcggaccagatgaatgtagcagatcccacgctctggcctcctgttcgtcctccctacaatttgccattgtttctcctgggttaggccccggcttcactggttgagtgttgctctctagtttccagaggcttaatcacaccgtcctccacgccatttccttttccttcaagcctagcccttctctcattatttctctctgaccctctccccactgctcatttggatcc

SEQ ID NO: 2895 - DNA, 237 bp; single-stranded, linear
ctgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgttttgcagaaccagaagaaggtggagttcaaaatagacatcgtggtgctagctttcc

SEQ ID NO: 2896 - DNA, 4040 bp; single-stranded, linear
tgcagagaacagagaaaggacatctgcgaggaaagttccctgatggctgtcaacaaagtgccacgtctctatggctgtgtacgctgagcacacgattttatcgcgcctatcatatcttggtgcataaacgcacctcacctcggtcaacccttgctccgtcttatgagacaggctttattatccgcattttatatgaggggaatctgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttccgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagagaacataaaatcctacatctgttatgaaatccgtgtgtatgcactctcaggggatcaaggaggatgcagctccatcctgggtaactctaagcacaaagcaccactgagtggcccccacattaatgccatcacagaggaaaaggggagcattttaatttcatggaacagcattccagtccaggagcaaatgggctgcctcctccattataggatatactggaaggaacgggactccaactcccagcctcagctctgtgaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaaggtgtttgttctcctagcagccctcagacctcagtggtgtagcagagaaattccagatccagcaaatagcacttgcgctaagaaatatcccattgcagaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagccagaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagcctccaaaacaaatcaacctagttctatagatgaagacataaaagacactggtaaacaccaatgtaaaagggcccccaaggtggtcatgactggtctcatttgcagaagtctaagaatgtacctttttctggccgggcgtggtagctcatgcctgtaatcccagcactttgggaggctga

SEQ ID NO: 2897 - DNA, 6019 bp; single-stranded, linear
caagcccagagccctgccatttctgtgggctcaggtccctactgctcagccccttcctccctcggcaaggccacaatgaaccggggagtcccttttaggcacttgcttctggtgctgcaactggcgctcctcccagcagccactcagggaaagaaagtggtgctgggcaaaaaaggggatacagtggaactgacctgtacagcttcccagaagaagagcatacaattccactggaaaaactccaaccagataaagattctgggaaatcagggctccttcttaactaaaggtccatccaagctgaatgatcgcgctgactcaagaagaagcctttgggaccaaggaaacttccccctgatcatcaagaatcttaagatagaagactcagatacttacatctgtgaagtggaggaccagaaggaggaggtgcaattgctagtgttcggattgactgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgtcttgcagaaccagaagaaggtggagttcaaaatagacatcgtggtgctagctttccagaaggcctccagcatagtctataagaaagagggggaacaggtggagttctccttcccactcgcctttacagttgaaaagctgacgggcagtggcgagctgtggtggcaggcggagagggcttcctcctccaagtcttggatcacctttgacctgaagaacaaggaagtgtctgtaaaacgggttacccaggaccctaagctccagatgggcaagaagctcccgctccacctcaccctgccccaggccttgcctcagtatgctggctctggaaacctcaccctggcccttgaagcgaaaacaggaaagttgcatcaggaagtgaacctggtggtgatgagagccactcagctccagaaaaatttgacctgtgaggtgtggggacccacctcccctaagctgatgctgagcttgaaactggagaacaaggaggcaaaggtctcgaagcgggagaaggcggtgtgggtgctgaaccctgaggcggggatgtggcagtgtctgctgagtgactcgggacaggtcctgctggaatccaacatcaaggttctgcccacatggtccaccccggtgcagccaatggccctgattgtgctggggggcgtcgccggcctcctgcttttcattgggctaggcatcttcttctgtgtcaggtgccggcaccgaaggcgccaagcagagcggatgtctcagatcaagagactcctcagtgagaagaagacctgccagtgccctcaccggtttcagaagacatgtagccccatttgaggcacgaggccaggcagatcccacttgcagcctccccaggtgtctgccccgcgtttcctgcctgcggaccagatgaatgtagcagatcccacgctctggcctcctgttcgtcctccctacaatttgccattgtttctcctgggttaggccccggcttcactggttgagtgttgctctctagtttccagaggcttaatcacaccgtcctccacgccatttccttttccttcaagcctagcccttctctcattatttctctctgaccctctccccactgctcatttggatccctgccaactctgacacccacctgcttcaggggcagagcctgaccctgaccttggagagcccccctggtagtagcccctcagtgcaatgtaggagtccaaggggtaaaaacatacagggggggaagaccctctccgtgtctcagctggagctccaggatagtggcacctggacatgcactgttttgcagaaccagaagaaggtggagttcaaaatagacatcgtggtgctagctttcctgcagagaacagagaaaggacatctgcgaggaaagttccctgatggctgtcaacaaagtgccacgtctctatggctgtgtacgctgagcacacgattttatcgcgcctatcatatcttggtgcataaacgcacctcacctcggtcaacccttgctccgtcttatgagacaggctttattatccgcattttatatgaggggaatctgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggaagaatacggagttctataccagagttgattgttgatggcacatacttttagaggatgctcattggcatttatgtttataatcacgtggctgttgattaaagcaaaaatagatgcgtgcaagagaggcgatgtgactgtgaagccttcccatgtaattttacttggatccactgtcaatattacatgctctttgaagcccagacaaggctgctttcactattccagacgtaacaagttaatcctgtacaagtttgacagaagaatcaattttcaccatggccactccctcaattctcaagtcacaggtcttccccttggtacaaccttgtttgtctgcaaactggcctgtatcaatagtgatgaaattcaaatatgtggagcagagatcttcgttggtgttgctccagaacagcctcaaaatttatcctgcatacagaagggagaacaggggactgtggcctgcacctgggaaagaggacgagacacccacttatacactgagtatactctacagctaagtggaccaaaaaatttaacctggcagaagcaatgtaaagacatttattgtgactatttggactttggaatcaacctcacccctgaatcacctgaatccaatttcacagccaaggttactgctgtcaatagtcttggaagctcctcttcacttccatccacattcacattcttggacatagtgaggcctcttcctccgtgggacattagaatcaaatttcaaaaggcttccgtgagcagatgtaccctttattggagagatgagggactggtactgcttaatcgactcagatatcggcccagtaacagcaggctctggaatatggttaatgttacaaaggccaaaggaagacatgatttgctggatctgaaaccatttacagaatatgaatttcagatttcctctaagctacatctttataagggaagttggagtgattggagtgaatcattgagagcacaaacaccagaagaagagcctactgggatgttagatgtctggtacatgaaacggcacattgactacagtagacaacagatttctcttttctggaagaatctgagtgtctcagaggcaagaggaaaaattctccactatcaggtgaccttgcaggagctgacaggagggaaagccatgacacagaacatcacaggacacacctcctggaccacagtcattcctagaaccggaaattgggctgtggctgtgtctgcagcaaattcaaaaggcagttctctgcccactcgtattaacataatgaacctgtgtgaggcagggttgctggctcctcgccaggtctctgcaaactcagagggcatggacaacattctggtgacttggcagcctcccaggaaagatccctctgctgttcaggagtacgtggtggaatggagagagctccatccagggggtgacacacaggtccctctaaactggctacggagtcgaccctacaatgtgtctgctctgatttcagagaacataaaatcctacatctgttatgaaatccgtgtgtatgcactctcaggggatcaaggaggatgcagctccatcctgggtaactctaagcacaaagcaccactgagtggcccccacattaatgccatcacagaggaaaaggggagcattttaatttcatggaacagcattccagtccaggagcaaatgggctgcctcctccattataggatatactggaaggaacgggactccaactcccagcctcagctctgtgaaattccctacagagtctcccaaaattcacatccaataaacagcctgcagccccgagtgacatatgtcctgtggatgacagctctgacagctgctggtgaaagttcccacggaaatgagagggaattttgtctgcaaggtaaagccaattggatggcgtttgtggcaccaagcatttgcattgctatcatcatggtgggcattttctcaacgcattacttccagcaaaaggtgtttgttctcctagcagccctcagacctcagtggtgtagcagagaaattccagatccagcaaatagcacttgcgctaagaaatatcccattgcagaggagaagacacagctgcccttggacaggctcctgatagactggcccacgcctgaagatcctgaaccgctggtcatcagtgaagtccttcatcaagtgaccccagttttcagacatcccccctgctccaactggccacaaagggaaaaaggaatccaaggtcatcaggcctctgagaaagacatgatgcacagtgcctcaagcccaccacctccaagagctctccaagctgagagcagacaactggtggatctgtacaaggtgctggagagcaggggctccgacccaaagccagaaaacccagcctgtccctggacggtgctcccagcaggtgaccttcccacccatgatggctacttaccctccaacatagatgacctcccctcacatgaggcacctctcgctgactctctggaagaactggagcctcagcacatctccctttctgttttcccctcaagttctcttcacccactcaccttctcctgtggtgataagctgactctggatcagttaaagatgaggtgtgactccctcatgctctgagtggtgaggcttcaagccttaaagtcagtgtgccctcaaccagcacagcctgccccaattcccccagcccctgctccagcagctgtcatctctgggtgccaccatcggtctggctgcagctagaggacaggcaagccagctctgggggagtcttaggaactgggagttggtcttcactcagatgcctcatcttgcctttcccagggccttaaaattacatccttcactgtgtggacctagagactccaacttgaattcctagtaactttcttggtatgctggccagaaagggaaatgaggaggagagtagaaaccacagctcttagtagtaatggcatacagtctagaggaccattcatgcaatgactatttctaaagcacctgctacacagcaggctgtacacagcagatcagtactgttcaacagaacttcctgagatgatggaaatgttctacctctgcactcactgtccagtacattagacactaggcacattggctgttaatcacttggaatgtgtttagcttgactgaggaattaaattttgattgtaaatttaaatcgccacacatggctagtggctactgtattggagtgcacagctctagatggctcctagattattgagagcctccaaaacaaatcaacctagttctatagatgaagacataaaagacactggtaaacaccaatgtaaaagggcccccaaggtggtcatgactggtctcatttgcagaagtctaagaatgtacctttttctggccgggcgtggtagctcatgcctgtaatcccagcactttgggaggctga

SEQ ID NO: 2898 - DNA, 5670 bp; single-stranded, linear
ggatccccgctgacaatctagaaacaagcaacagaccctctgatgtagccatctgtgccgcgcctctccgcaccgcccgccacgccttggtccctggagaccaccctccagggcaggggctgccgctcggccgggcccgcggggtccctcggcctgacatggccggtgctggagcggcacgtgcgcgcctcggcccctcggccgctcccgcccctcgccggtgcgcaccggcgctcggggagccgctggcccgggtgtccagccggcccttgccctgcctggcgctcggaccgccacctttgccgccccctcgccagcctccgcagcttccagactggccggtctgcgcgcccacccctgcctcccggaccggccaccgccggaggccgcggaggagggcccggccgcgcagatcccgcttatcgggccccatctcccgttacataaggccacccccctatctccgcgggccatcgccgccgcaaccgccgcgccagcgccttctcccacgcgcgggggcgcccctgcccaccgctcccggcagggcttttggtggccatgggggataaggggcgttgactcacccgggcggggctccgggagttgcacagaccaaggtagttccccgctccttcccccatcacggagaccctgtgggagatgccgtgggccctctactacagattaggaaacaggcccgtagaggggtcgcgcggccaagtagcggcactccaggcactgggggccctcgagggaaggggcagacttctgggagtcagagccagcagctgggctgggaagcttcgagtgtggacagagagggtgggaatgacgttccctgtgggaagagagggtgggcaagcctgggatgcctctgagcgggaatccagcatgccttgtgaggagggtcacaagcacacccttgtgaggaggttgagccccatcgaggacaggacggagggagcctgagcaggcagagagggggcctggggaggcgctggttcggggaggaagtgggtaggggagaaatcttgacatcaacacccaacaggcaaatgccgtggcctctgctgtgggggtttctggaggacttctaggaaaacgagggaagagcaggaaaaggcgacatggctgtagggccaagcccaggagccgccctccacagcactcattctgcagaagggaaatttgaggcccccagacggcaggggttgatcctgcagagactggtgagcaaaggggatcaccccaagccccagtggcactaggaacacttacaatctctgacctggactaaggctgccagcctggcccagttaagagtttcccagaaggatggcccatacactttaaattaaaggggccagacacgtgcacactacttccagccactctggaagctgaggtggggggatcgcttgagtctgggagttggaggccagcctaggcaggcaacatagtgagaccccatctccaaaaaaacaaaacaaaacaaaacaaaaaaacaccaaaaaagctcccagaaagacctctgaatctttctggatctctcagtggagacctggaaatctgaactttgacaatccctctcacagtggggccaaggaggaattaggcaagccaaaagaagtgaactttactcttctattgcctgtttgaattttgtatccaagcaagtgttacttaagtaatttaagagactggttcatcgaaaaaataaaactccccaaattcccatagctggtagactgtggtcacagccacagtgcactaagactatctgctcagcacttctggtgacccaaaagggtctgaggacaggagctcagagttgggtcagctgtccaggtactcagggttgtcacaggcaaaactgctggaactcagggcagcattgcaaatgccacgccgctctcagggccccttgcctgccgctggaattaaacccacccagatcttggaaactctgccctggacccttctcaataagtccatgagaaatcaaactctttcctttatgcgacactggattttccacaaagtaaaatcaagatgagtaaagatgtggtttctagatagtgcctgaaaaagcagagaccatggtgtcaggcgtcaccacttgggcctataaaagctgccacaagacgccaaggccacaagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggtgagtgtcggctagccagggtcctagctatgagggctccagggtgggtgattcccaagatgaggtcatgagcaggctgggcctggtcctaagatgcctgtaggtcaggaaaaatctccatggaccaaggcccggcccagccatgagggagagaggagctgggctggggggctcagcactgtggatggacctatggaggtgtctggcagactccccagggactacctgctctcctggcctggccttgtctgccactgccagctcctactcagccattcctgaacagaggacagcagagaagggccagcaccctcccagaaccatgtggcatttgccaactggattttgaccataacaatgcagccattctccccagcaccatcataggcccgcccttacaggaggattcgttagtagagtccgctccttgccccactagtaacagctcacatgtctgagcactgcttacaccaggcctggtgcacgtgctttatgtgtcatttcatcactgccagccacctcaagaggcaggtacgatgaacccattctgctaaggttcagtgaggttaagtgacagaggctggattcaagccaggcctggccaacaccagagtgtccatgctcctaactgcagtgttccctcaccatcagaaggcagggcatttaatacaccagatccccaccgcctcccatctgatttgtcttggtcaacagtggcccaggccactcctacttcactcgtccccaccctggcccttcccgcaggcccctgtcctcctgccctgactatggcaagccttgcatgcagcttgtcccttactagtggtgtcaatttttttctctcagctccaagaccctaaacagtgggacctcacccctatgcctgctgttcaaagcagaaaacgaagctcaggaatgctgaggggctgccaggcctgcctctgtgccacaccagggatgcttgtggggcctgtgctggggcagacctggcctgggctgccagggcaggcccacaacccctgccagcactctgctcactgtcactttgctcccacaggctccgctctgcaatggcagcatggtatggagcatcaacctgacagctggcatggtaaggacctttgggtgcagggaggatggggcagaggctccaggccttgggcttatcttctctgagcctcccttccatggctggggttccaagcaagcttcaagtgctctcctccctcccgccataatctggccccttcccgcccaccacccagactcacctgcgccaggcatctcagccccatcttcctgcagactcacaaaaggcagctgcccaagcagggcctgacccctcggtgtcccctccccacagtactgtgcagccctggaatccctgatcaacgtgtcaggctgcagtgccatcgagaagacccagaggatgctgagcggattctgcccgcacaaggtctcagctggggtaaggcatcccccaccctctcacacccaccctgcaccccctcctgccaaccctgggctcgctgaagggaagctggctgaatatccatggtgtgtgtccacccaggggtggggccattgtggcagcagggacgtggccttcgggatttacaggatctgggctcaagggctcctaactcctacctgggcctcaatttccacatctgtacagtagaggtactaacagtacccacctcatggggacttccgtgaggactgaatgagacagtccctggaaagcccctggtttgtgcgagtcgtcccggcctctggcgttctactcacgtgctgacctctttgtcctgcagcagttttccagcttgcatgtccgagacaccaaaatcgaggtggcccagtttgtaaaggacctgctcttacatttaaagaaactttttcgcgagggacggttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctggcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattgaacaagttgtttcattgactatcaaactgaagccagaaataaagttggtgacagataggcctgattgtatttgtctttcattttggcctttggggacactggtctgtggtctgaagactctgaggagctcttcgggaggctggtgggttggaggaggggactgggatggattacagcgagggtagggtgcagtgacctgggctgaatgcaagctagctcccgagggtggggacatggcctgaaggaagccccaccttctgtctgctgcaccagcaaggacggagaggcttgggccagactgtcagggttcaaggagggcatcaggagcagacggagacccaggaagtctcacaatcacatctcctgaggactggccagctgtgtctggcaccacccacacatccatgtctccctcacaacccaggaggccgatgagaactgtgaggctcagaaagcgtgggcggtttgcctaaggtcacgtagctacttcctcactggggtcctggggcctcagagcctcatctgaggtaaaggagcaaagttgggattggggtccaaaattcactttaactccaaagcccacacacttaaccaccctgcctatttctgtccaaatgtcacctgtcctgaat

SEQ ID NO: 2899 - DNA, 1282 bp; single-stranded, linear
aagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacggttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctggcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattgaacaagttgtttcattgactatcaaactgaagccagaaataaagttggtgacagat

SEQ ID NO: 2900 - DNA, 6952 bp; single-stranded, linear
ggatccccgctgacaatctagaaacaagcaacagaccctctgatgtagccatctgtgccgcgcctctccgcaccgcccgccacgccttggtccctggagaccaccctccagggcaggggctgccgctcggccgggcccgcggggtccctcggcctgacatggccggtgctggagcggcacgtgcgcgcctcggcccctcggccgctcccgcccctcgccggtgcgcaccggcgctcggggagccgctggcccgggtgtccagccggcccttgccctgcctggcgctcggaccgccacctttgccgccccctcgccagcctccgcagcttccagactggccggtctgcgcgcccacccctgcctcccggaccggccaccgccggaggccgcggaggagggcccggccgcgcagatcccgcttatcgggccccatctcccgttacataaggccacccccctatctccgcgggccatcgccgccgcaaccgccgcgccagcgccttctcccacgcgcgggggcgcccctgcccaccgctcccggcagggcttttggtggccatgggggataaggggcgttgactcacccgggcggggctccgggagttgcacagaccaaggtagttccccgctccttcccccatcacggagaccctgtgggagatgccgtgggccctctactacagattaggaaacaggcccgtagaggggtcgcgcggccaagtagcggcactccaggcactgggggccctcgagggaaggggcagacttctgggagtcagagccagcagctgggctgggaagcttcgagtgtggacagagagggtgggaatgacgttccctgtgggaagagagggtgggcaagcctgggatgcctctgagcgggaatccagcatgccttgtgaggagggtcacaagcacacccttgtgaggaggttgagccccatcgaggacaggacggagggagcctgagcaggcagagagggggcctggggaggcgctggttcggggaggaagtgggtaggggagaaatcttgacatcaacacccaacaggcaaatgccgtggcctctgctgtgggggtttctggaggacttctaggaaaacgagggaagagcaggaaaaggcgacatggctgtagggccaagcccaggagccgccctccacagcactcattctgcagaagggaaatttgaggcccccagacggcaggggttgatcctgcagagactggtgagcaaaggggatcaccccaagccccagtggcactaggaacacttacaatctctgacctggactaaggctgccagcctggcccagttaagagtttcccagaaggatggcccatacactttaaattaaaggggccagacacgtgcacactacttccagccactctggaagctgaggtggggggatcgcttgagtctgggagttggaggccagcctaggcaggcaacatagtgagaccccatctccaaaaaaacaaaacaaaacaaaacaaaaaaacaccaaaaaagctcccagaaagacctctgaatctttctggatctctcagtggagacctggaaatctgaactttgacaatccctctcacagtggggccaaggaggaattaggcaagccaaaagaagtgaactttactcttctattgcctgtttgaattttgtatccaagcaagtgttacttaagtaatttaagagactggttcatcgaaaaaataaaactccccaaattcccatagctggtagactgtggtcacagccacagtgcactaagactatctgctcagcacttctggtgacccaaaagggtctgaggacaggagctcagagttgggtcagctgtccaggtactcagggttgtcacaggcaaaactgctggaactcagggcagcattgcaaatgccacgccgctctcagggccccttgcctgccgctggaattaaacccacccagatcttggaaactctgccctggacccttctcaataagtccatgagaaatcaaactctttcctttatgcgacactggattttccacaaagtaaaatcaagatgagtaaagatgtggtttctagatagtgcctgaaaaagcagagaccatggtgtcaggcgtcaccacttgggcctataaaagctgccacaagacgccaaggccacaagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggtgagtgtcggctagccagggtcctagctatgagggctccagggtgggtgattcccaagatgaggtcatgagcaggctgggcctggtcctaagatgcctgtaggtcaggaaaaatctccatggaccaaggcccggcccagccatgagggagagaggagctgggctggggggctcagcactgtggatggacctatggaggtgtctggcagactccccagggactacctgctctcctggcctggccttgtctgccactgccagctcctactcagccattcctgaacagaggacagcagagaagggccagcaccctcccagaaccatgtggcatttgccaactggattttgaccataacaatgcagccattctccccagcaccatcataggcccgcccttacaggaggattcgttagtagagtccgctccttgccccactagtaacagctcacatgtctgagcactgcttacaccaggcctggtgcacgtgctttatgtgtcatttcatcactgccagccacctcaagaggcaggtacgatgaacccattctgctaaggttcagtgaggttaagtgacagaggctggattcaagccaggcctggccaacaccagagtgtccatgctcctaactgcagtgttccctcaccatcagaaggcagggcatttaatacaccagatccccaccgcctcccatctgatttgtcttggtcaacagtggcccaggccactcctacttcactcgtccccaccctggcccttcccgcaggcccctgtcctcctgccctgactatggcaagccttgcatgcagcttgtcccttactagtggtgtcaatttttttctctcagctccaagaccctaaacagtgggacctcacccctatgcctgctgttcaaagcagaaaacgaagctcaggaatgctgaggggctgccaggcctgcctctgtgccacaccagggatgcttgtggggcctgtgctggggcagacctggcctgggctgccagggcaggcccacaacccctgccagcactctgctcactgtcactttgctcccacaggctccgctctgcaatggcagcatggtatggagcatcaacctgacagctggcatggtaaggacctttgggtgcagggaggatggggcagaggctccaggccttgggcttatcttctctgagcctcccttccatggctggggttccaagcaagcttcaagtgctctcctccctcccgccataatctggccccttcccgcccaccacccagactcacctgcgccaggcatctcagccccatcttcctgcagactcacaaaaggcagctgcccaagcagggcctgacccctcggtgtcccctccccacagtactgtgcagccctggaatccctgatcaacgtgtcaggctgcagtgccatcgagaagacccagaggatgctgagcggattctgcccgcacaaggtctcagctggggtaaggcatcccccaccctctcacacccaccctgcaccccctcctgccaaccctgggctcgctgaagggaagctggctgaatatccatggtgtgtgtccacccaggggtggggccattgtggcagcagggacgtggccttcgggatttacaggatctgggctcaagggctcctaactcctacctgggcctcaatttccacatctgtacagtagaggtactaacagtacccacctcatggggacttccgtgaggactgaatgagacagtccctggaaagcccctggtttgtgcgagtcgtcccggcctctggcgttctactcacgtgctgacctctttgtcctgcagcagttttccagcttgcatgtccgagacaccaaaatcgaggtggcccagtttgtaaaggacctgctcttacatttaaagaaactttttcgcgagggacggttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctggcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattgaacaagttgtttcattgactatcaaactgaagccagaaataaagttggtgacagataggcctgattgtatttgtctttcattttggcctttggggacactggtctgtggtctgaagactctgaggagctcttcgggaggctggtgggttggaggaggggactgggatggattacagcgagggtagggtgcagtgacctgggctgaatgcaagctagctcccgagggtggggacatggcctgaaggaagccccaccttctgtctgctgcaccagcaaggacggagaggcttgggccagactgtcagggttcaaggagggcatcaggagcagacggagacccaggaagtctcacaatcacatctcctgaggactggccagctgtgtctggcaccacccacacatccatgtctccctcacaacccaggaggccgatgagaactgtgaggctcagaaagcgtgggcggtttgcctaaggtcacgtagctacttcctcactggggtcctggggcctcagagcctcatctgaggtaaaggagcaaagttgggattggggtccaaaattcactttaactccaaagcccacacacttaaccaccctgcctatttctgtccaaatgtcacctgtcctgaataagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacggttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctggcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattgaacaagttgtttcattgactatcaaactgaagccagaaataaagttggtgacagat

SEQ ID NO: 2901 - DNA, 1270 bp; single-stranded, linear
ttcggcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacggttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctggcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattgaacaagttgtttcattgactatcaaactgaagccagaaataaagttggtgacagat

SEQ ID NO: 2902 - DNA, 3999 bp; single-stranded, linear
tcagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcaccc

SEQ ID NO: 2903 - DNA, 4039 bp; single-stranded, linear
tgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcaagcgggccgccaccgcggtggaaactccagctt

SEQ ID NO: 2904 - DNA, 5670 bp; single-stranded, linear; identical to SEQ ID NO: 2898

SEQ ID NO: 2905 - DNA, 14978 bp; single-stranded, linear
ttcggcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggctccgctctgcaatggcagcatggtatggagcatcaacctgacagctggcatgtactgtgcagccctggaatccctgatcaacgtgtcaggctgcagtgccatcgagaagacccagaggatgctgagcggattctgcccgcacaaggtctcagctgggcagttttccagcttgcatgtccgagacaccaaaatcgaggtggcccagtttgtaaaggacctgctcttacatttaaagaaactttttcgcgagggacggttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctggcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattgaacaagttgtttcattgactatcaaactgaagccagaaataaagttggtgacagattcagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcaccctgccaaggctccagcccggccgggctccgaggcgagaggctgcatggagtggccggcgcggctctgcgggctgtgggcgctgctgctctgcgccggcggcgggggcgggggcgggggcgccgcgcctacggaaactcagccacctgtgacaaatttgagtgtctctgttgaaaacctctgcacagtaatatggacatggaatccacccgagggagccagctcaaattgtagtctatggtattttagtcattttggcgacaaacaagataagaaaatagctccggaaactcgtcgttcaatagaagtacccctgaatgagaggatttgtctgcaagtggggtcccagtgtagcaccaatgagagtgagaagcctagcattttggttgaaaaatgcatctcacccccagaaggtgatcctgagtctgctgtgactgagcttcaatgcatttggcacaacctgagctacatgaagtgttcttggctccctggaaggaataccagtcccgacactaactatactctctactattggcacagaagcctggaaaaaattcatcaatgtgaaaacatctttagagaaggccaatactttggttgttcctttgatctgaccaaagtgaaggattccagttttgaacaacacagtgtccaaataatggtcaaggataatgcaggaaaaattaaaccatccttcaatatagtgcctttaacttcccgtgtgaaacctgatcctccacatattaaaaacctctccttccacaatgatgacctatatgtgcaatgggagaatccacagaattttattagcagatgcctattttatgaagtagaagtcaataacagccaaactgagacacataatgttttctacgtccaagaggctaaatgtgagaatccagaatttgagagaaatgtggagaatacatcttgtttcatggtccctggtgttcttcctgatactttgaacacagtcagaataagagtcaaaacaaataagttatgctatgaggatgacaaactctggagtaattggagccaagaaatgagtataggtaagaagcgcaattccacactctacataaccatgttactcattgttccagtcatcgtcgcaggtgcaatcatagtactcctgctttacctaaaaaggctcaagattattatattccctccaattcctgatcctggcaagatttttaaagaaatgtttggagaccagaatgatgatactctgcactggaagaagtacgacatctatgagaagcaaaccaaggaggaaaccgactctgtagtgctgatagaaaacctgaagaaagcctctcagtgatggagataatttatttttaccttcactgtgaccttgagaagattcttcccattctccatttgttatctgggaacttattaaatggaaactgaaactactgcaccatttaaaaacaggcagctcataagagccacaggtctttatgttgagtcgcgcaccgaaaaactaaaaataatgggcgctttggagaagagtgtggagtcattctcattgaattataaaagccagcaggcttcaaactaggggacaaagcaaaaagtgatgatagtggtggagttaatcttatcaagagttgtgacaacttcctgagggatctatacttgctttgtgttctttgtgtcaacatgaacaaattttatttgtaggggaactcatttggggtgcaaatgctaatgtcaaacttgagtcacaaagaacatgtagaaaacaaaatggataaaatctgatatgtattgtttgggatcctattgaaccatgtttgtggctattaaaactcttttaacagtctgggctgggtccggtggctcacgcctgtaatcccagcaatttgggagtccgaggcgggcggatcactcgaggtcaggagttccagaccagcctgaccaaaatggtgaaacctcctctctactaaaactacaaaaattaactgggtgtggtggcgcgtgcctgtaatcccagctactcgggaagctgaggcaggtgaattgtttgaacctgggaggtggaggttgcagtgagcagagatcacaccactgcactctagcctgggtgacagagcaagactctgtctaaaaaacaaaacaaaacaaaacaaaacaaaaaaacctcttaatattctggagtcatcattcccttcgacagcattttcctctgctttgaaagccccagaaatcagtgttggccatgatgacaactacagaaaaaccagaggcagcttctttgccaagacctttcaaagccattttaggctgttaggggcagtggaggtagaatgactccttgggtattagagtttcaaccatgaagtctctaacaatgtattttcttcacctctgctactcaagtagcatttactgtgtctttggtttgtgctaggcccccgggtgtgaagcacagaccccttccaggggtttacagtctatttgagactcctcagttcttgccacttttttttttaatctccaccagtcatttttcagaccttttaactcctcaattccaacactgatttccccttttgcattctccctccttcccttccttgtagccttttgactttcattggaaattaggatgtaaatctgctcaggagacctggaggagcagaggataattagcatctcaggttaagtgtgagtaatctgagaaacaatgactaattcttgcatattttgtaacttccatgtgagggttttcagcattgatatttgtgcattttctaaacagagatgaggtggtatcttcacgtagaacattggtattcgcttgagaaaaaaagaatagttgaacctatttctctttctttacaagatgggtccaggattcctcttttctctgccataaatgattaattaaatagcttttgtgtcttacattggtagccagccagccaaggctctgtttatgcttttggggggcatatattgggttccattctcacctatccacacaacatatccgtatatatcccctctactcttacttcccccaaatttaaagaagtatgggaaatgagaggcatttcccccaccccatttctctcctcacacacagactcatattactggtaggaacttgagaactttatttccaagttgttcaaacatttaccaatcatattaatacaatgatgctatttgcaattcctgctcctaggggaggggagataagaaaccctcactctctacaggtttgggtacaagtggcaacctgcttccatggccgtgtagaagcatggtgccctggcttctctgaggaagctggggttcatgacaatggcagatgtaaagttattcttgaagtcagattgaggctgggagacagccgtagtagatgttctactttgttctgctgttctctagaaagaatatttggttttcctgtataggaatgagattaattcctttccaggtattttataattctgggaagcaaaacccatgcctccccctagccatttttactgttatcctatttagatggccatgaagaggatgctgtgaaattcccaacaaacattgatgctgacagtcatgcagtctgggagtggggaagtgatcttttgttcccatcctcttcttttagcagtaaaatagctgagggaaaagggagggaaaaggaagttatgggaatacctgtggtggttgtgatccctaggtcttgggagctcttggaggtgtctgtatcagtggatttcccatcccctgtgggaaattagtaggctcatttactgttttaggtctagcctatgtggattttttcctaacatacctaagcaaacccagtgtcaggatggtaattcttattctttcgttcagttaagtttttcccttcatctgggcactgaagggatatgtgaaacaatgttaacatttttggtagtcttcaaccagggattgtttctgtttaacttcttataggaaagcttgagtaaaataaatattgtctttttgtatgtcaagcgggccgccaccgcggtggaaactccagcttggatccccgctgacaatctagaaacaagcaacagaccctctgatgtagccatctgtgccgcgcctctccgcaccgcccgccacgccttggtccctggagaccaccctccagggcaggggctgccgctcggccgggcccgcggggtccctcggcctgacatggccggtgctggagcggcacgtgcgcgcctcggcccctcggccgctcccgcccctcgccggtgcgcaccggcgctcggggagccgctggcccgggtgtccagccggcccttgccctgcctggcgctcggaccgccacctttgccgccccctcgccagcctccgcagcttccagactggccggtctgcgcgcccacccctgcctcccggaccggccaccgccggaggccgcggaggagggcccggccgcgcagatcccgcttatcgggccccatctcccgttacataaggccacccccctatctccgcgggccatcgccgccgcaaccgccgcgccagcgccttctcccacgcgcgggggcgcccctgcccaccgctcccggcagggcttttggtggccatgggggataaggggcgttgactcacccgggcggggctccgggagttgcacagaccaaggtagttccccgctccttcccccatcacggagaccctgtgggagatgccgtgggccctctactacagattaggaaacaggcccgtagaggggtcgcgcggccaagtagcggcactccaggcactgggggccctcgagggaaggggcagacttctgggagtcagagccagcagctgggctgggaagcttcgagtgtggacagagagggtgggaatgacgttccctgtgggaagagagggtgggcaagcctgggatgcctctgagcgggaatccagcatgccttgtgaggagggtcacaagcacacccttgtgaggaggttgagccccatcgaggacaggacggagggagcctgagcaggcagagagggggcctggggaggcgctggttcggggaggaagtgggtaggggagaaatcttgacatcaacacccaacaggcaaatgccgtggcctctgctgtgggggtttctggaggacttctaggaaaacgagggaagagcaggaaaaggcgacatggctgtagggccaagcccaggagccgccctccacagcactcattctgcagaagggaaatttgaggcccccagacggcaggggttgatcctgcagagactggtgagcaaaggggatcaccccaagccccagtggcactaggaacacttacaatctctgacctggactaaggctgccagcctggcccagttaagagtttcccagaaggatggcccatacactttaaattaaaggggccagacacgtgcacactacttccagccactctggaagctgaggtggggggatcgcttgagtctgggagttggaggccagcctaggcaggcaacatagtgagaccccatctccaaaaaaacaaaacaaaacaaaacaaaaaaacaccaaaaaagctcccagaaagacctctgaatctttctggatctctcagtggagacctggaaatctgaactttgacaatccctctcacagtggggccaaggaggaattaggcaagccaaaagaagtgaactttactcttctattgcctgtttgaattttgtatccaagcaagtgttacttaagtaatttaagagactggttcatcgaaaaaataaaactccccaaattcccatagctggtagactgtggtcacagccacagtgcactaagactatctgctcagcacttctggtgacccaaaagggtctgaggacaggagctcagagttgggtcagctgtccaggtactcagggttgtcacaggcaaaactgctggaactcagggcagcattgcaaatgccacgccgctctcagggccccttgcctgccgctggaattaaacccacccagatcttggaaactctgccctggacccttctcaataagtccatgagaaatcaaactctttcctttatgcgacactggattttccacaaagtaaaatcaagatgagtaaagatgtggtttctagatagtgcctgaaaaagcagagaccatggtgtcaggcgtcaccacttgggcctataaaagctgccacaagacgccaaggccacaagccacccagcctatgcatccgctcctcaatcctctcctgttggcactgggcctcatggcgcttttgttgaccacggtcattgctctcacttgccttggcggctttgcctccccaggccctgtgcctccctctacagccctcagggagctcattgaggagctggtcaacatcacccagaaccagaaggtgagtgtcggctagccagggtcctagctatgagggctccagggtgggtgattcccaagatgaggtcatgagcaggctgggcctggtcctaagatgcctgtaggtcaggaaaaatctccatggaccaaggcccggcccagccatgagggagagaggagctgggctggggggctcagcactgtggatggacctatggaggtgtctggcagactccccagggactacctgctctcctggcctggccttgtctgccactgccagctcctactcagccattcctgaacagaggacagcagagaagggccagcaccctcccagaaccatgtggcatttgccaactggattttgaccataacaatgcagccattctccccagcaccatcataggcccgcccttacaggaggattcgttagtagagtccgctccttgccccactagtaacagctcacatgtctgagcactgcttacaccaggcctggtgcacgtgctttatgtgtcatttcatcactgccagccacctcaagaggcaggtacgatgaacccattctgctaaggttcagtgaggttaagtgacagaggctggattcaagccaggcctggccaacaccagagtgtccatgctcctaactgcagtgttccctcaccatcagaaggcagggcatttaatacaccagatccccaccgcctcccatctgatttgtcttggtcaacagtggcccaggccactcctacttcactcgtccccaccctggcccttcccgcaggcccctgtcctcctgccctgactatggcaagccttgcatgcagcttgtcccttactagtggtgtcaatttttttctctcagctccaagaccctaaacagtgggacctcacccctatgcctgctgttcaaagcagaaaacgaagctcaggaatgctgaggggctgccaggcctgcctctgtgccacaccagggatgcttgtggggcctgtgctggggcagacctggcctgggctgccagggcaggcccacaacccctgccagcactctgctcactgtcactttgctcccacaggctccgctctgcaatggcagcatggtatggagcatcaacctgacagctggcatggtaaggacctttgggtgcagggaggatggggcagaggctccaggccttgggcttatcttctctgagcctcccttccatggctggggttccaagcaagcttcaagtgctctcctccctcccgccataatctggccccttcccgcccaccacccagactcacctgcgccaggcatctcagccccatcttcctgcagactcacaaaaggcagctgcccaagcagggcctgacccctcggtgtcccctccccacagtactgtgcagccctggaatccctgatcaacgtgtcaggctgcagtgccatcgagaagacccagaggatgctgagcggattctgcccgcacaaggtctcagctggggtaaggcatcccccaccctctcacacccaccctgcaccccctcctgccaaccctgggctcgctgaagggaagctggctgaatatccatggtgtgtgtccacccaggggtggggccattgtggcagcagggacgtggccttcgggatttacaggatctgggctcaagggctcctaactcctacctgggcctcaatttccacatctgtacagtagaggtactaacagtacccacctcatggggacttccgtgaggactgaatgagacagtccctggaaagcccctggtttgtgcgagtcgtcccggcctctggcgttctactcacgtgctgacctctttgtcctgcagcagttttccagcttgcatgtccgagacaccaaaatcgaggtggcccagtttgtaaaggacctgctcttacatttaaagaaactttttcgcgagggacggttcaactgaaacttcgaaagcatcattatttgcagagacaggacctgactattgaagttgcagattcatttttctttctgatgtcaaaaatgtcttgggtaggcgggaaggagggttagggaggggtaaaattccttagcttagacctcagcctgtgctgcccgtcttcagcctagccgacctcagccttccccttgcccagggctcagcctggtgggcctcctctgtccagggccctgagctcggtggacccagggatgacatgtccctacacccctcccctgccctagagcacactgtagcattacagtgggtgccccccttgccagacatgtggtgggacagggacccacttcacacacaggcaactgaggcagacagcagctcaggcacacttcttcttggtcttatttattattgtgtgttatttaaatgagtgtgtttgtcaccgttggggattggggaagactgtggctgctggcacttggagccaagggttcagagactcagggccccagcactaaagcagtggaccccaggagtccctggtaataagtactgtgtacagaattctgctacctcactggggtcctggggcctcggagcctcatccgaggcagggtcaggagaggggcagaacagccgctcctgtctgccagccagcagccagctctcagccaacgagtaatttattgtttttcctcgtatttaaatattaaatatgttagcaaagagttaatatatagaagggtaccttgaacactgggggaggggacattgaacaagttgtttcattgactatcaaactgaagccagaaataaagttggtgacagataggcctgattgtatttgtctttcattttggcctttggggacactggtctgtggtctgaagactctgaggagctcttcgggaggctggtgggttggaggaggggactgggatggattacagcgagggtagggtgcagtgacctgggctgaatgcaagctagctcccgagggtggggacatggcctgaaggaagccccaccttctgtctgctgcaccagcaaggacggagaggcttgggccagactgtcagggttcaaggagggcatcaggagcagacggagacccaggaagtctcacaatcacatctcctgaggactggccagctgtgtctggcaccacccacacatccatgtctccctcacaacccaggaggccgatgagaactgtgaggctcagaaagcgtgggcggtttgcctaaggtcacgtagctacttcctcactggggtcctggggcctcagagcctcatctgaggtaaaggagcaaagttgggattggggtccaaaattcactttaactccaaagcccacacacttaaccaccctgcctatttctgtccaaatgtcacctgtcctgaat

SEQ ID NO: 2906 - DNA, 1793 bp; single-stranded, linear
caacaccttcagaaataatcctttgggtgatctcttgtcaatcatttgtgcaggctagagaggcacctgtgaatgataaggctactgagaagcatcattggcctggtcctggcactaccaaagggcaggggaagcgatgcccaaggggctcctgaccagcacatcatcccacgcaaaaacattctccaggtcccttgttccaggcaggaaatccccagctctgagcgccctgccagggctctgcctagggacaccttttccaggtctagagaatcaaaggagcctccagagcagctaggagggcctgagctgaccaagcaagccctgctcacaagacaaatgcagtcaagacctgggtgtattacttgtcttgagctctgaagggcagggaggggtctgagcctcaaatcagacagagaaatgctcaagtcacttctgccaactcactgtgatggcagctacagatgacagcccctctcaagactcttcagctcacagacaagccactgacttcatctgtacacacccccatccccaatgcaagcccactgtacacttacaggtataaatgcatttgcaaggccttgcaaaatgccctatgtacgtaaaactgacccacaaaatccaaaattgcaagtgccagatgccagccaggtcagaacatcctggcttcagcaatgggctgctcagcatgggagccttttatgggccaggcctggctgggctgccgctcccttcccagcatgacccaacaccaggctctctaggccctggcggaggtgggctcttgaggcccagtctggcctgatgcttctgtgctcggtgctcctgggtagcaaggcgcttctgtgaccctgggggagctgggtgcttgagccccaggcccctctggcctcctctcagggccactgtcagtgagggagccctggccaccagcactcaggtcctgtaccctcttgttcaggtcattgcgctctgtctgcagtgcccggcacagcttctccagccgttggatttttacctgcaggccctccagttctttatcccggactgttttctcctcagccatctcaagcagggccttgttgctgctctcccaccgggaccggtacatggtggtttctttctccagcttcttgatcttcttagtcatcttttccatctcctgcttgaatgtggtgaatacctcgctgcttttggaaagtgtgttctggaactcctcaaacttctctgtgtatagggcaagctgttgcttcaggtgggtctcttgctgcttcatcagctcacacatcctctgggactctactgcctctttcaggagaaaatccttctcccgctggtgccgctcttctgcctcctttagcatctcctgggcctgctggagcttggcatccaccagctgctgttgtaggtccttgtgtttgaagactttgtcgatatgctcctcgcgcagctcatactgctcaatcagcttcttgagcctctcagccagctccatgttctcttggcgcagcttggagttgcgctcattgtgctgttccatctgcagctgaatgtcattcagtgtcacctggaagtgcgaggtcacctccttgcgcttctcctcctcctcccgggcccgctgcacaccttcttccttgagggagcggttgtgcccgtgcagctcacggcataggctctcaagcttgctgcgggccaggacggcttgctgtgctcaccgcgcaggtggtccttctcttgcaccagctggctctgctttttctgtaggagcttcatctgcttctgtgaattcc

SEQ ID NO: 2907 - DNA, 1793 bp; single-stranded, linear; identical to SEQ ID NO: 2906

SEQ ID NO: 2908 - DNA, 1248 bp; single-stranded, linear
aaatcctggctgtcatgtacttgctatgggcctagagtagcttacctaaatgctactaaccttcctccataccattattgtaaagattaaaggtgatgcatctgttaagtaactaatagagtgcttattaaaaggtaggtgttcaataagtattaattccctccctttctttttcttactagtgcacttgtgtttttaatggatcatactttaccctagattgtattgtaggaggcatcgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggatgcagctaatatacccagttggcccaaagcacctaacctatagttatataatctgactctcagttcagttttactctactaatgccttcatggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggagaaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaaaaaaaaaaaaaaaaaa

SEQ ID NO: 2909 - DNA, 1202 bp; single-stranded, linear
tgtccggcgccccccgggagggaactgggtggccgcaccctcccggctgcggtggctgtcgccccccaccctgcagccaggactcgatggagaatccattccaatatatggccatgtggctctttggagcaatgttccatcatgttccatgctgctgctgacgtcacatggagcacagaaatcaatgttagcagatagccagcccatacaagatcgtattgtattgtaggaggcatcgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttaaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgct

SEQ ID NO: 2910 - DNA, 14968 bp; single-stranded, linear
ggcattgtaatcagacagaactggcctcaaatcctggctgtcatgtacttgctatgggcctagagtagcttacctaaatgctactaaccttcctccataccattattgtaaagattaaaggtgatgcatctgttaagtaactaatagagtgcttattaaaaggtaggtgttcaataagtattaattccctttctttctttttcttactagtgcacttgtgtttttaatggatcatactttaccctagattgtattgtaggaggcatcgtggatggatggctgctggaaaccccttgccatagccagctcttcttcaatacttaaggatttaccgtggctttgagtaatgagaatttccggtaagaagaaaaatagatgaaaatatcctatggaatttcccttaaaggtcgtctgaatctcagagtctttgcaataagttacatggttattctccaaagatcttgagatatcacagatgtctgttcacatttggattgttcttattttgaaaataaataggtttttaaaaactctattgaccatcttgataggctcttcttgtcattataaatgtgttatttcacttatcccactcttttgtgttctctaaatgtctttgtactcactaaattgtgtagtcttagagggcagggtgtgggtatcattcatctttttgaaaggaagcatgaacaattagtggttaaggtggcagttaacactgctttctgaaactttaaaagcttcgacaacacaaaagaggcaggtgaaagtaccaaaactctggtaagttgtaggataaatgattttcctaaatcaccaagaaagattattagtcactctcaagatggaatacagtatctgtaattggttccattttatccaatttttcaccaaataatattaatataattcattttcataatttacatgaagttaatataactattgcatctctgttagtaatgcatgttattaacctgtgctgtataaaatattttgacctattaaaaaagaaagaaggatgaggaggaggtcaaagataatataaaaactttaagtggtgacattggtatgtatgtaaattaacaaatatgtcaactttgttaaattatctttgacatgcatctgcagaaatatctgttaaggaactttgtgcataagagacagagttggaggtgggagagaaagtgaaaaaagataaattatagttttattatttttgataaggggcagtaattatgaaattatgacaaacttacatctttagacctagaaatatgttgacatgttattttaaacctcactttttaactaaaaaatttaaccatttgtctatgattatatttttcagaaaccacatttgagaagtatttccatccagtgctacttgtgtttacttctaaacagtcattttctaactgaagctggcattcatgtcttcattttgggggtaattttatctttaggcataaataacattatgttcatggtcatgatgattgtccttggatatattttccattaaattagtttacgttcagtttgcttatatctctaggtactcagtatctgggggatagaaggcagactacagagatttagagaggtttggtaaacacctaactgagcatttttctacattgtggtaatagtccaaacaagcattatagccctcaaataaattgggccttttgatatttaactgaacttggaagtataccacttattgatagactacatatttttcatggcaattaaaagtagatatttagaatttgcttatgttacttttttatctgtccctgacactgactcctcctatcccttgatctttatcctagttcagtttaaaacatttctttctttatttaagccttttgttgtttccttctaataaaattcatatgtttccatgactattaacttttttcttctctcttagatgcagctaatatacccagttggcccaaagcacctaacctatagttatataatctgactctcagttcagttttactctactaatgccttcatggtattgggaaccatagatttgtgcaggtaattcttcatcataagacagattagtgttgactatcatgcttctgtgtaagatccatcaggaagtgagtgattatttttcctcaagctctaagcatcattccaatgttacttggtcagtataagtgtattttgtctggatattaaattttaatttttatgaaatttgtgaaagtgagtaagtatatgatcattcagcctacactggaatgaagtctgtactgtttatggagaaagctgctgcaagcatagtaagagtgtgagcaacatgaaaggggcatgtttaatgtagtgtaaaaaaaatttactatcaaaatcattacatgaaaatgattattactcattttaagaattttacctatttattagacttcaaagtctctgtaaatctctacttaaaggaaactagtaattcattcaaaatcatttattgagcattgccacacatctggcactgcttctatttcattgtgataaattgagccagtttatttataaagtatgcctacagttaggcttttctctaatccgggttggtgaagcctcaagttatcataaaatgccaaaattgtactatatgctcaatgtttatgttcagttacaaggctgttgaatgcacagaagcaaggataacactgattttttcactggtcagaataaaaattattgattgctcttttgcttatagtattcatcaagatgaataggctccttcaaaatgctttgctctatggtttttctttcagctgtttcagtgcagggcttcctaaaacagaagccaactgggtgaatgtaataagtgatttgaaaaaaattgaagatcttattcaagtgagtactcatttttccataaaatgcctggtataactgctatggagtttgtctctctctgtgtttttctgtctgtcttaaggaaaccacacttgaaacaataatatttttgtagaaatttatgatcttataaagctcaaaaagaagtcttttccttactgttttagaatctaattatctttaaaacgtaatttataagcggcccagacggatgagttctagtctgcacaggtgaggtattctcttcctctatctggagaagccagatatcttggtggcacctgcagggagaatggcttgacccagggaacagctgttgttgcttgtggactaaaggccctcttctcccacctcaagaaaacaggtggcctgacctaaggaagtgatttttgccatagcaggtaataccagcttcagtggaagtctcgatggcaccaagcataccaaaatagcaccacaaagttctgaaaactaaattgtcattggaatcacagcattaaaaaataggttagaacttgcatgctaaatccaaacaacctgactgcatgttaaaatagaagatttaaataggaccagagtgtcctaacataatagacatgaagccaagatacaattggaaatcacccattgtaacaagaaataggaaagttacaacttaaatgagaaaatatagtcaacagattacaaaattgaagtggatcagatgttggaattctctgacatagatttgaaagcagacattataaaaagtgcttgaaaaagcaattacaaatgcccttgaagcaaatgaaaaactaaatgccttaacaaagaaatagaagatatgaaaggaaccatatagaaattatataactgaaaatataactgaaatataaagcaaactgtaaaggctcattagcagaatgaatgacagaggaatgatagttaatttgacaacagaatactagagagacagttgacttaagaaaaaaaaagcatcactgatcttgacgacagtaacaaaagattcagcattcctatggttagtatcacaggagagtatgagaatacaccaagtaaaagagagagattggttgaattcataacaaaacaccacccatctatactatctataagcagttcacttctagtacaatgacatacataggttgaaatttaaaaagacagaaaaagatatagcatactataatgggttgaatagtgtccccccaaatttcacatcctcttggaaccttaaaatgtgatcttattttgaaataatatctttgcaaatataattaatgaaattaagatgagatcatactagagtagggggggccctaaatccaatgacaagtgtctttattagaaaaggaaaggacacagagtaactcactgggaagaaagccatgtgaagacagaggaagagatcagagtgatgcggctataagccaaggaaggccagagattgccaggatccaccagaaccttggggaagtcaagaaagcattcttctctagactgatacacatgcatacattaattataaaaagcagaagtggctatattaacatcaaagttaatgttattaacataaagtagacttcacagaaaataaagttgctataatccagagggatattacaaaatgataaaaaataaatctgtgaggaaaacataatgttcttaaatgtatacacatcaaacaacgaagactcaaaatttgtgaaacaaaaaataatagggataaaagagaaatagacaaatccacaattattcttgaggacttcactgcctcctcctcagtaactaatggaagtactagacagaaaatcagaaagggcataaaaatacaatataaccaaccaacaggatctaatttaatacatagagcactacacccaacaacagcagaatatactttcttttatcaagactaaatatatactgagccataaaagaaactttaaaaattttttcagaacttaaatcatgcagaatttgttctcaaaccacaatggaatcaaaccagaaatcaagaaattaaatacaacgggcaaatctccaaatgcttggaaattaaatactatacctctatataatccatgggtcaaagagtaaatctcaaaggatattcataatacatagaatgaaaaaaaatgaaatacagcatatcaagatatatgtgatgtggctaaagcaatactgacaggacattttttaaaatcaaatgaatacattagaaaaaaaggagaattatcaaatcaaaaatctaagttactgcttcaagaaactagaagaagtagagcaaaacaaattcaatacaagcagaacaaagaaaatatttaaatataagagccaaaattaatgaagttgaaatcaagaaaacaatagaaaaaattaatgaaacataaaactggttatttggaaaatcaatacaattgatctttaattgacagaaataagagagaagacacaaatctcaggaatgaaatttggggctgtcactacagaatctgcagtcattagaaggataataagaaaaactatgaacaattttatgctcacaaatctgataacttagaggaaatggaccaattcttcagaaaccacaaactaccaaaacataatgaagatgaaatagacaatccaaacactcatataatcactaaatacattgaattcatcatacacaagctcccaaaaagggaccttcaagcctgctggttacactgaatcattctatcaaatatttacagaagcattaacaacaattgtacagtctcttctagaaaatagaagaggaaggaacattttccagttgattttaggaggccagtattactgtgatgctaaaaccaaataaagatattactaaaaaagacaactacaaaaatatctcccattaacttagatattaaaatgctctataaaatattaacaaatcgaattcagcaatgtataaaaagaattatacaccatgaccgagtgagatttatttcaggtacacaagtcttgctcaattatttgaaagtcaagcaatgtaatctaccctatcaacaggctaaagaagaaaatcatatgtagaaaaggtatctgataaaatgcaacacctctcatggcctgtgtccctccctatgcctcctggatttatatgttgaagtactaattgccagtatatcaaaatgtgactgtattttgagatagggtcagttaaaatgaggtcatgagggcaggtcctactgcaatatgactggtatctttagaaaaacagataagggtatagatacacagagatagaaaaccatgtgaagacactgggagaaaatggccacctataagccaaggagggaggactccaaagaaaccaacactgctggtaccctgatttcagacctctagcctcctgaattgtgagaaaataaagttctattatttaagtcaccaagtctgtggtactttttatagcagccctagcagactgatataaacacctattgaagataaaatttcttagaaagtaggtgtggagaactgcctcaacttggtacaaaacatgttcaaaaagtctagagctaccatacttaatggtgagtacaagactgaatgtttttctgctaggactggaaactaagcagggatatcttctctcaccacttttactcaacataattgtctgagttttctgttgcttataacagagtacttgaaatgcataatttataaagaaaggaatttatgtcttatggttatgagactgaaaagttcaaggttgaggagccacatctggtgagggccttcctgctggtgggggctctctggagtccagaggtgacaaaaagcatcacatggcgaggggctgaatgtactcatgtgctagctcaggtctctcttcctcttcttataaaactaccggttccctttccgtaataacacattgatactctaatccattcatgagggcagagccattgtgatccaattacctcttaaagccccacctctcaatactgccacattggggattaagtttcaatctgaattttggaggggacattcaaaccacagcaataatattggaagtttagccaaattatgaagcaggagagaaaaaatgtatgagaaaaaaataaataaaaggcacacagattggaaaggaaaattatacatcaccccaagttttttggagagaaagtagtaaaaatgggtatattttgtttagaaagtaatgcaaattaaaaccacaatgacatattattacatgcagctataagcgtatacagaataaaaaatagtgatgatgctaagtaaatataaatgaacaagggtgataatgctggcaaggatgtggagaaactggatcattcatacattgctggtgatgatgtaaaatgatacaggcactgtataaaatagtttggcagcatcctatgaaacaaaacatgcatttgccttacaatccaacaattgtgctcttagacattcatccttgataaatgaaaactacgtgcacacaaaaatatgtacatgaatgttcacagagattttttcatgactgccaaaaactggaaacagatgtgcttcagttggtaaaatctgtgatatatcatgtcagggaatactacagagcaataaaaaggaacaaactagtgatacccacaagttaggtggatctccagggtattatgatgagtgaaaaaagccagtcttcataaagaaactgtggtacatttataaaatagaatattatccagtgataaaaagaaataagctatcaagccatgaaaagaaatggagaaaccttcaaagtcatattgttgagtgaaagatggggacgccaatctgaaaaggcttcacactgtatgatcccaactatgacattttgaaaaaggcaaagctatggagacaataaaaagatcagtggttgttaggggtttggagggaaggagaaatggctaggcagagcacaggctacttttaaagcagtgaaaatattaatatatgatgatgggtggcattatacatttgtcaaaacctgtaaaacatacaacacaaataatgagccctaatattctgtacacttaagatcataatagtgattcaccaactataacaaacacaccacactaatgcaagatattaacaatagggaaactggggtggagaacaaaggggtgtataagtctctgtactttctgctagtttttctgtaaacctaaatggctcataaaaatgtctatcaattcttttaaaagctaatttcagaaggttacatatgatatgagtccgtttacataatattcttgaaatgacaaaattataggcatggagagcagagaagtggttgccagaatttagagagattgggtgatgatgaggtatgtatggggagaaaggtgactttggttatgaaagaatagcagcagaatccttgtggtgatgaaactattttgtgtcttaactgtggtggtggtgatgtgaatctatgcaaatgataaaattgcataaaacttcacacatatgcaagcacacacactgtggcacataaaacttgtgaaatctgaacaaggtgagtgcattgtattaatgtcaattttctgattgtaatactgtactgtggttatggaagacattaccactgggagaagcttgttgaagggtacacaggatctctctgtatttactcttacagtttcatatgaattttaaattatctcaaaataaaaaaagaattaaaaacaatttaatgttttcagtaggttgttctcataatatttaaagcagggcatagtttttaatattgtctaattttgtttcctttcagtctatgcatattgatgctactttatatacggaaagtgatgttcacgtgagtatactttttttcaaaattgctatttgtcttgttattaaagtttttaaaagtatatttttgtaacaactaaaatatggtagttttaaaatctaacttttggtgtgtttctataatatatggtccatgagttttattagtgattattgagatgggacttggggacagatagctacatcaatgctatttttgtaatggtgccaaatcaaaatattaaaagagtcttttccatcaatgtcaaacaagatacattatacgtttttgtgatgcagttgcatcatggtgcaattagatgcaaaaatcagattaactgtttcaatttaagagtagccaatatatcagttatttccaatgctgtaatgtatcaccatctgcaatcatattttccataaattgcttaaaatcattcatgttctgcattttacatgattctctacatttgtcagaaaaagattctaattattctctatgtgagaaaggaaacataacccatgaaacttattagaactgaaaaatggtcttgaacttgtttcattaataccctgacatttcctaaggaatgtaggatttgtcatgttggtggtggttcttcccttcagtattgttactaaaaccaagaaatgaatccccaacttcacgtcagggaaaacaaactctatgtcctctctccattattcctcaattagaacttctcttacatagatgactttctaagcattggaaagaaaccatagtcagaaactagaaaaaagagatattcactaaccaattgggtcatgctgctgcacaaagaaattgtctccctcctctggcttcagcatggattctgtttttctttgcattttttgtaaaatggaaagtagtcaattagccaccaaattcagcatcctgaaattgcttttttgcaagaagataactttgcaacccatgggttagagaaacaaccttagattttagattttagattttagaagtttagattttaaaactgactccaccactttttacttgtgttaccttggagattgctaaacatttctgaagctcatttttattattgctgatatggtgacagtatttgtctttcaatcctaagcagtgactgttgggtttaaggaatattaccagtgctgggcacatgggtgtattccttcattttttttatccattcagtaagcatttgtgaagtgtctgcaggctcccaggtactgtgcaaggtatcgaggacacaaagtcaaataatggtcaaatccctagatattccttgtttcctttctttaagttattgttaaagtaaatgttgtggaaaacatatttttgtggcacctaagagagccttttctgatttgatctgcctgtaagtggacactagtcctgctttgatttttctaataaatttcttggaattacttctctccctctggaactttggaacttgaaagaacagtataattagcagctaccactatttaaaatgttaacaacacaatttgattctaaaaattcttacaaataaactgtctatattgatgttttcagactctaaggccagtattattaccctttccacaggggaaatgtgctcggtgagaaaaactggccactatttctgcattttctagtttcatgttcttctgtacaatattgccatccttcttgattgtgttttgttggtttgttttggtttttattttaaagccaaaagaaaaaaaattaagctgcctcctatgtaaaatttcttaaggatattgtgtatctttataaaatatttggattgactttttgaaaatcaaaattacatcagtatgaaaattaataatcagaaaaaagtaattgttctttataacttttatttttagcccagttgcaaagtaacagcaatgaagtgctttctcttggagttacaagttatttcacttgagtccggagatgcaagtattcatgatacagtagaaaatctgatcatcctagcaaacaacagtttgtcttctaatggggtgagttttccaacagttgcttagagttgcatcttatgttttgggcctgatttggagaagtcattcatggacaagcagatcctcctaaggggcaatcaggagaaggagtcctgttccagtggagtggtgtgcaaaagtggcaccatctccagcatgcacacaatgctaaactgttcaatgattgattcagtagacaaacatttacagaataatgccaggtagtgtgcttcagtgctagaattatagttgcaaaccagacagacaggtcactgacctcaaggtgtttattgtcaggtgcagtggatagacattaatctaattacatactcaaatgtctaacatcaataatagtaactcacatttattgagttattactgtatgccagacactattctttgagctttaaattgataattcatttaatcctcatgataaatctgtgagatagttatctttatttctgtttgaatgttgaagaaattgtagcactgagagcctggatcactcgcttcagttcatacagctagtaaaatggggagccacaactcttacccgagcagtctgtctgcagagtctgttatctcatgagaagataaatgctttaaaaagataacaatgaaaatattaatgattcgagtataatctgggacatcccaggcaacttgagcagtagagggttccaggagagcaaattctaggtactcgtatgataggctggggaatcagctgtgcaatggccctgaagtgcaaagaattagggctttcatggcaaaacaccagtggccaaagcaaggtagagagaaagcagttttgcaacaaagaggcataatcaaattagttcatttcataaatactttttagccctcaggagacagtatgaaaaaatacccataatccctgctgttaaagagggaggaaacagaaataaaccaagcactcagcaaatgagtaataagttagttatttatgaagtccagtggtgaaaaaggacacagggtaggggcactggggctccagttagggtaggctgagctaataagctgccatttgacaaagatgtgagagaatgagccttaagggtatctagggacatatgtttaggcagagacaactgaaagtgcaaaggccctaagcttgtgtgggtggacaccttgacttttctctaaaaatacaagactgctttaggtctttgcttcagtgtcaccttctcagtgatttacctatttacagttgcaatcccttccctatctgagcactccctgtccccttctctgcgtgtcccatatctggaatatgatatattttatgtaatgggtattgtctgtttttccctactagaatgtcagcttaaaatggacaagtgtttttgttttttattagtactatatccaaattcccagaacagtgtctcatatatattaaatactttacatatgtatgaaatgaatttattaaggtttataatactcttatgatgttatctccatcttattggtggaaagagtgagccacgcaacaggtaactcatggcaaaataaatgatgagctctttaatgtgaatgttgatagtcatcctcatcatgacagagtgtgacatacgtgctggaatgcgtgggcaggactgcacagtcagaagacctggatgggaagaatttcagttgattatgtcagttgagatgagtcaatatctctgtcttcctatctgacatgattattttcaggatcaaataggacagcattatatgaaatatgacagtgcttggcatagaggatgtgcttgataaatgtcgctgattctgaattccaaatagttaatggatataaaatctaatttttatttttgctggcacagccttcatggttcagatgatctctaaaaagtttattcttaattgctacatttggaacattctagttatccatgagactgtgtttgaagtacaacaatttgtggtattcacctaaatggctcagttcaaccaatgggtgattacagtgtgtcaggccctgtgctaaatgctagggaaacaaacatactggctctgaccttctggcagagagcttagagaatagtattacagtataaaaagagtaaaacttcataatatgaatagaatacatgacatattgtgagagaggtctaaataaggggttctgagatgtaaagatgggacattgagtccagccctaggagcccaggggttcagagaagcctccctaaaagagtacctgaataatcttaagtgcgagtagcagcagctaaaataggaatgaatgtaacagagagaaaagcaaaggcagagaggcatctaatagtatgctgtgcatggcaaggaaagccagatgctcactcagtgtttctagggcataacattgaggcaagggggatatgtgaaataaataggtaaggaacagctcatgaagagcctgtgtgctatgcagggaggcatggtctttatgctagaagcagatgataggaaaccattgaagggctcaaagcaggaactccgtggtctgatagacacagcttatttttctcaatgtccttaacccattattggaaaaataaacatatatcaaatctccctgttctctttcctcgtagttcttcctaatatgctatttatttgctaaagctttcatatctcaagacctcaccatatggttcaaacgatatgatattcccattcccatgaatgtatatttaatttaattataaattgccaatttaatctctctctatattttgcagaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaaataaagaaattgcaataactggcatataatgtccatcagtaaatcttggtggtggtggcaataataaacttctactgataggtagaatggtgtgcaagcttgtccaatcacggattgcaggccacatgcggcccaggacaactttgaatgtggcccaacacaaattcataaactttcatacatctcgtttttagctcatcagctatcattagcggtagtgtatttaaagtgtggcccaagacaattcttcttattccaatgtggcccagggaaatcaaaagattggatgcccctggtatagaaaactaatagtgacagtgttcatatttcatgctttcccaaatacaggtattttattttcacattctttttgccatgtttatataataataaagaaaaaccctgttgatttgttggagccattgttatctgacagaaaataattgtttatattttttgcactacactgtctaaaattagcaagctctcttctaatggaactgtaagaaagatgaaatatttttgttttattataaatttatttcaccttaattctggtaatactcactgagtgactgtggggtgggaaatgatctcttaagaatttgatttctttctattccatagtacaaactcgttctctgttgaaacattcttctatcaccccagtgccctatccatgtacatgtgttcttattgctctagtcaaacggtgcttataaatatctttcagaaagcttaggagaaatctgtatcctatttgacttccaataatca

SEQ ID NO: 2911 - DNA, 486 bp; single-stranded, linear
cggattgggatcggacctacttgattcacttctgggaaatcaaggatctacgtaccatggattttcaggtgcagattttcagcttcctgctaatcagtgcctcagtcataatgtctagagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattcctcgag

SEQ ID NO: 2912 - DNA, 17904 bp; single-stranded, linear
aaatcctggctgtcatgtacttgctatgggcctagagtagcttacctaaatgctactaaccttcctccataccattattgtaaagattaaaggtgatgcatctgttaagtaactaatagagtgcttattaaaaggtaggtgttcaataagtattaattccctccctttctttttcttactagtgcacttgtgtttttaatggatcatactttaccctagattgtattgtaggaggcatcgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggatgcagctaatatacccagttggcccaaagcacctaacctatagttatataatctgactctcagttcagttttactctactaatgccttcatggtattgggaaccatagatttgtgcagctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggagaaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaaaaaaaaaaaaaaaaaatgtccggcgccccccgggagggaactgggtggccgcaccctcccggctgcggtggctgtcgccccccaccctgcagccaggactcgatggagaatccattccaatatatggccatgtggctctttggagcaatgttccatcatgttccatgctgctgctgacgtcacatggagcacagaaatcaatgttagcagatagccagcccatacaagatcgtattgtattgtaggaggcatcgtggatggatggctgctggaaaccccttgccatagccagctcttcttcaatacttaaggatttaccgtggctttgagtaatgagaatttcgaaaccacatttgagaagtatttccatccagtgctacttgtgtttacttctaaacagtcattttctaactgaagctggcattcatgtcttcattttgggctgtttcagtgcagggcttcctaaaacagaagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttaaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctggcattgtaatcagacagaactggcctcaaatcctggctgtcatgtacttgctatgggcctagagtagcttacctaaatgctactaaccttcctccataccattattgtaaagattaaaggtgatgcatctgttaagtaactaatagagtgcttattaaaaggtaggtgttcaataagtattaattccctttctttctttttcttactagtgcacttgtgtttttaatggatcatactttaccctagattgtattgtaggaggcatcgtggatggatggctgctggaaaccccttgccatagccagctcttcttcaatacttaaggatttaccgtggctttgagtaatgagaatttccggtaagaagaaaaatagatgaaaatatcctatggaatttcccttaaaggtcgtctgaatctcagagtctttgcaataagttacatggttattctccaaagatcttgagatatcacagatgtctgttcacatttggattgttcttattttgaaaataaataggtttttaaaaactctattgaccatcttgataggctcttcttgtcattataaatgtgttatttcacttatcccactcttttgtgttctctaaatgtctttgtactcactaaattgtgtagtcttagagggcagggtgtgggtatcattcatctttttgaaaggaagcatgaacaattagtggttaaggtggcagttaacactgctttctgaaactttaaaagcttcgacaacacaaaagaggcaggtgaaagtaccaaaactctggtaagttgtaggataaatgattttcctaaatcaccaagaaagattattagtcactctcaagatggaatacagtatctgtaattggttccattttatccaatttttcaccaaataatattaatataattcattttcataatttacatgaagttaatataactattgcatctctgttagtaatgcatgttattaacctgtgctgtataaaatattttgacctattaaaaaagaaagaaggatgaggaggaggtcaaagataatataaaaactttaagtggtgacattggtatgtatgtaaattaacaaatatgtcaactttgttaaattatctttgacatgcatctgcagaaatatctgttaaggaactttgtgcataagagacagagttggaggtgggagagaaagtgaaaaaagataaattatagttttattatttttgataaggggcagtaattatgaaattatgacaaacttacatctttagacctagaaatatgttgacatgttattttaaacctcactttttaactaaaaaatttaaccatttgtctatgattatatttttcagaaaccacatttgagaagtatttccatccagtgctacttgtgtttacttctaaacagtcattttctaactgaagctggcattcatgtcttcattttgggggtaattttatctttaggcataaataacattatgttcatggtcatgatgattgtccttggatatattttccattaaattagtttacgttcagtttgcttatatctctaggtactcagtatctgggggatagaaggcagactacagagatttagagaggtttggtaaacacctaactgagcatttttctacattgtggtaatagtccaaacaagcattatagccctcaaataaattgggccttttgatatttaactgaacttggaagtataccacttattgatagactacatatttttcatggcaattaaaagtagatatttagaatttgcttatgttacttttttatctgtccctgacactgactcctcctatcccttgatctttatcctagttcagtttaaaacatttctttctttatttaagccttttgttgtttccttctaataaaattcatatgtttccatgactattaacttttttcttctctcttagatgcagctaatatacccagttggcccaaagcacctaacctatagttatataatctgactctcagttcagttttactctactaatgccttcatggtattgggaaccatagatttgtgcaggtaattcttcatcataagacagattagtgttgactatcatgcttctgtgtaagatccatcaggaagtgagtgattatttttcctcaagctctaagcatcattccaatgttacttggtcagtataagtgtattttgtctggatattaaattttaatttttatgaaatttgtgaaagtgagtaagtatatgatcattcagcctacactggaatgaagtctgtactgtttatggagaaagctgctgcaagcatagtaagagtgtgagcaacatgaaaggggcatgtttaatgtagtgtaaaaaaaatttactatcaaaatcattacatgaaaatgattattactcattttaagaattttacctatttattagacttcaaagtctctgtaaatctctacttaaaggaaactagtaattcattcaaaatcatttattgagcattgccacacatctggcactgcttctatttcattgtgataaattgagccagtttatttataaagtatgcctacagttaggcttttctctaatccgggttggtgaagcctcaagttatcataaaatgccaaaattgtactatatgctcaatgtttatgttcagttacaaggctgttgaatgcacagaagcaaggataacactgattttttcactggtcagaataaaaattattgattgctcttttgcttatagtattcatcaagatgaataggctccttcaaaatgctttgctctatggtttttctttcagctgtttcagtgcagggcttcctaaaacagaagccaactgggtgaatgtaataagtgatttgaaaaaaattgaagatcttattcaagtgagtactcatttttccataaaatgcctggtataactgctatggagtttgtctctctctgtgtttttctgtctgtcttaaggaaaccacacttgaaacaataatatttttgtagaaatttatgatcttataaagctcaaaaagaagtcttttccttactgttttagaatctaattatctttaaaacgtaatttataagcggcccagacggatgagttctagtctgcacaggtgaggtattctcttcctctatctggagaagccagatatcttggtggcacctgcagggagaatggcttgacccagggaacagctgttgttgcttgtggactaaaggccctcttctcccacctcaagaaaacaggtggcctgacctaaggaagtgatttttgccatagcaggtaataccagcttcagtggaagtctcgatggcaccaagcataccaaaatagcaccacaaagttctgaaaactaaattgtcattggaatcacagcattaaaaaataggttagaacttgcatgctaaatccaaacaacctgactgcatgttaaaatagaagatttaaataggaccagagtgtcctaacataatagacatgaagccaagatacaattggaaatcacccattgtaacaagaaataggaaagttacaacttaaatgagaaaatatagtcaacagattacaaaattgaagtggatcagatgttggaattctctgacatagatttgaaagcagacattataaaaagtgcttgaaaaagcaattacaaatgcccttgaagcaaatgaaaaactaaatgccttaacaaagaaatagaagatatgaaaggaaccatatagaaattatataactgaaaatataactgaaatataaagcaaactgtaaaggctcattagcagaatgaatgacagaggaatgatagttaatttgacaacagaatactagagagacagttgacttaagaaaaaaaaagcatcactgatcttgacgacagtaacaaaagattcagcattcctatggttagtatcacaggagagtatgagaatacaccaagtaaaagagagagattggttgaattcataacaaaacaccacccatctatactatctataagcagttcacttctagtacaatgacatacataggttgaaatttaaaaagacagaaaaagatatagcatactataatgggttgaatagtgtccccccaaatttcacatcctcttggaaccttaaaatgtgatcttattttgaaataatatctttgcaaatataattaatgaaattaagatgagatcatactagagtagggggggccctaaatccaatgacaagtgtctttattagaaaaggaaaggacacagagtaactcactgggaagaaagccatgtgaagacagaggaagagatcagagtgatgcggctataagccaaggaaggccagagattgccaggatccaccagaaccttggggaagtcaagaaagcattcttctctagactgatacacatgcatacattaattataaaaagcagaagtggctatattaacatcaaagttaatgttattaacataaagtagacttcacagaaaataaagttgctataatccagagggatattacaaaatgataaaaaataaatctgtgaggaaaacataatgttcttaaatgtatacacatcaaacaacgaagactcaaaatttgtgaaacaaaaaataatagggataaaagagaaatagacaaatccacaattattcttgaggacttcactgcctcctcctcagtaactaatggaagtactagacagaaaatcagaaagggcataaaaatacaatataaccaaccaacaggatctaatttaatacatagagcactacacccaacaacagcagaatatactttcttttatcaagactaaatatatactgagccataaaagaaactttaaaaattttttcagaacttaaatcatgcagaatttgttctcaaaccacaatggaatcaaaccagaaatcaagaaattaaatacaacgggcaaatctccaaatgcttggaaattaaatactatacctctatataatccatgggtcaaagagtaaatctcaaaggatattcataatacatagaatgaaaaaaaatgaaatacagcatatcaagatatatgtgatgtggctaaagcaatactgacaggacattttttaaaatcaaatgaatacattagaaaaaaaggagaattatcaaatcaaaaatctaagttactgcttcaagaaactagaagaagtagagcaaaacaaattcaatacaagcagaacaaagaaaatatttaaatataagagccaaaattaatgaagttgaaatcaagaaaacaatagaaaaaattaatgaaacataaaactggttatttggaaaatcaatacaattgatctttaattgacagaaataagagagaagacacaaatctcaggaatgaaatttggggctgtcactacagaatctgcagtcattagaaggataataagaaaaactatgaacaattttatgctcacaaatctgataacttagaggaaatggaccaattcttcagaaaccacaaactaccaaaacataatgaagatgaaatagacaatccaaacactcatataatcactaaatacattgaattcatcatacacaagctcccaaaaagggaccttcaagcctgctggttacactgaatcattctatcaaatatttacagaagcattaacaacaattgtacagtctcttctagaaaatagaagaggaaggaacattttccagttgattttaggaggccagtattactgtgatgctaaaaccaaataaagatattactaaaaaagacaactacaaaaatatctcccattaacttagatattaaaatgctctataaaatattaacaaatcgaattcagcaatgtataaaaagaattatacaccatgaccgagtgagatttatttcaggtacacaagtcttgctcaattatttgaaagtcaagcaatgtaatctaccctatcaacaggctaaagaagaaaatcatatgtagaaaaggtatctgataaaatgcaacacctctcatggcctgtgtccctccctatgcctcctggatttatatgttgaagtactaattgccagtatatcaaaatgtgactgtattttgagatagggtcagttaaaatgaggtcatgagggcaggtcctactgcaatatgactggtatctttagaaaaacagataagggtatagatacacagagatagaaaaccatgtgaagacactgggagaaaatggccacctataagccaaggagggaggactccaaagaaaccaacactgctggtaccctgatttcagacctctagcctcctgaattgtgagaaaataaagttctattatttaagtcaccaagtctgtggtactttttatagcagccctagcagactgatataaacacctattgaagataaaatttcttagaaagtaggtgtggagaactgcctcaacttggtacaaaacatgttcaaaaagtctagagctaccatacttaatggtgagtacaagactgaatgtttttctgctaggactggaaactaagcagggatatcttctctcaccacttttactcaacataattgtctgagttttctgttgcttataacagagtacttgaaatgcataatttataaagaaaggaatttatgtcttatggttatgagactgaaaagttcaaggttgaggagccacatctggtgagggccttcctgctggtgggggctctctggagtccagaggtgacaaaaagcatcacatggcgaggggctgaatgtactcatgtgctagctcaggtctctcttcctcttcttataaaactaccggttccctttccgtaataacacattgatactctaatccattcatgagggcagagccattgtgatccaattacctcttaaagccccacctctcaatactgccacattggggattaagtttcaatctgaattttggaggggacattcaaaccacagcaataatattggaagtttagccaaattatgaagcaggagagaaaaaatgtatgagaaaaaaataaataaaaggcacacagattggaaaggaaaattatacatcaccccaagttttttggagagaaagtagtaaaaatgggtatattttgtttagaaagtaatgcaaattaaaaccacaatgacatattattacatgcagctataagcgtatacagaataaaaaatagtgatgatgctaagtaaatataaatgaacaagggtgataatgctggcaaggatgtggagaaactggatcattcatacattgctggtgatgatgtaaaatgatacaggcactgtataaaatagtttggcagcatcctatgaaacaaaacatgcatttgccttacaatccaacaattgtgctcttagacattcatccttgataaatgaaaactacgtgcacacaaaaatatgtacatgaatgttcacagagattttttcatgactgccaaaaactggaaacagatgtgcttcagttggtaaaatctgtgatatatcatgtcagggaatactacagagcaataaaaaggaacaaactagtgatacccacaagttaggtggatctccagggtattatgatgagtgaaaaaagccagtcttcataaagaaactgtggtacatttataaaatagaatattatccagtgataaaaagaaataagctatcaagccatgaaaagaaatggagaaaccttcaaagtcatattgttgagtgaaagatggggacgccaatctgaaaaggcttcacactgtatgatcccaactatgacattttgaaaaaggcaaagctatggagacaataaaaagatcagtggttgttaggggtttggagggaaggagaaatggctaggcagagcacaggctacttttaaagcagtgaaaatattaatatatgatgatgggtggcattatacatttgtcaaaacctgtaaaacatacaacacaaataatgagccctaatattctgtacacttaagatcataatagtgattcaccaactataacaaacacaccacactaatgcaagatattaacaatagggaaactggggtggagaacaaaggggtgtataagtctctgtactttctgctagtttttctgtaaacctaaatggctcataaaaatgtctatcaattcttttaaaagctaatttcagaaggttacatatgatatgagtccgtttacataatattcttgaaatgacaaaattataggcatggagagcagagaagtggttgccagaatttagagagattgggtgatgatgaggtatgtatggggagaaaggtgactttggttatgaaagaatagcagcagaatccttgtggtgatgaaactattttgtgtcttaactgtggtggtggtgatgtgaatctatgcaaatgataaaattgcataaaacttcacacatatgcaagcacacacactgtggcacataaaacttgtgaaatctgaacaaggtgagtgcattgtattaatgtcaattttctgattgtaatactgtactgtggttatggaagacattaccactgggagaagcttgttgaagggtacacaggatctctctgtatttactcttacagtttcatatgaattttaaattatctcaaaataaaaaaagaattaaaaacaatttaatgttttcagtaggttgttctcataatatttaaagcagggcatagtttttaatattgtctaattttgtttcctttcagtctatgcatattgatgctactttatatacggaaagtgatgttcacgtgagtatactttttttcaaaattgctatttgtcttgttattaaagtttttaaaagtatatttttgtaacaactaaaatatggtagttttaaaatctaacttttggtgtgtttctataatatatggtccatgagttttattagtgattattgagatgggacttggggacagatagctacatcaatgctatttttgtaatggtgccaaatcaaaatattaaaagagtcttttccatcaatgtcaaacaagatacattatacgtttttgtgatgcagttgcatcatggtgcaattagatgcaaaaatcagattaactgtttcaatttaagagtagccaatatatcagttatttccaatgctgtaatgtatcaccatctgcaatcatattttccataaattgcttaaaatcattcatgttctgcattttacatgattctctacatttgtcagaaaaagattctaattattctctatgtgagaaaggaaacataacccatgaaacttattagaactgaaaaatggtcttgaacttgtttcattaataccctgacatttcctaaggaatgtaggatttgtcatgttggtggtggttcttcccttcagtattgttactaaaaccaagaaatgaatccccaacttcacgtcagggaaaacaaactctatgtcctctctccattattcctcaattagaacttctcttacatagatgactttctaagcattggaaagaaaccatagtcagaaactagaaaaaagagatattcactaaccaattgggtcatgctgctgcacaaagaaattgtctccctcctctggcttcagcatggattctgtttttctttgcattttttgtaaaatggaaagtagtcaattagccaccaaattcagcatcctgaaattgcttttttgcaagaagataactttgcaacccatgggttagagaaacaaccttagattttagattttagattttagaagtttagattttaaaactgactccaccactttttacttgtgttaccttggagattgctaaacatttctgaagctcatttttattattgctgatatggtgacagtatttgtctttcaatcctaagcagtgactgttgggtttaaggaatattaccagtgctgggcacatgggtgtattccttcattttttttatccattcagtaagcatttgtgaagtgtctgcaggctcccaggtactgtgcaaggtatcgaggacacaaagtcaaataatggtcaaatccctagatattccttgtttcctttctttaagttattgttaaagtaaatgttgtggaaaacatatttttgtggcacctaagagagccttttctgatttgatctgcctgtaagtggacactagtcctgctttgatttttctaataaatttcttggaattacttctctccctctggaactttggaacttgaaagaacagtataattagcagctaccactatttaaaatgttaacaacacaatttgattctaaaaattcttacaaataaactgtctatattgatgttttcagactctaaggccagtattattaccctttccacaggggaaatgtgctcggtgagaaaaactggccactatttctgcattttctagtttcatgttcttctgtacaatattgccatccttcttgattgtgttttgttggtttgttttggtttttattttaaagccaaaagaaaaaaaattaagctgcctcctatgtaaaatttcttaaggatattgtgtatctttataaaatatttggattgactttttgaaaatcaaaattacatcagtatgaaaattaataatcagaaaaaagtaattgttctttataacttttatttttagcccagttgcaaagtaacagcaatgaagtgctttctcttggagttacaagttatttcacttgagtccggagatgcaagtattcatgatacagtagaaaatctgatcatcctagcaaacaacagtttgtcttctaatggggtgagttttccaacagttgcttagagttgcatcttatgttttgggcctgatttggagaagtcattcatggacaagcagatcctcctaaggggcaatcaggagaaggagtcctgttccagtggagtggtgtgcaaaagtggcaccatctccagcatgcacacaatgctaaactgttcaatgattgattcagtagacaaacatttacagaataatgccaggtagtgtgcttcagtgctagaattatagttgcaaaccagacagacaggtcactgacctcaaggtgtttattgtcaggtgcagtggatagacattaatctaattacatactcaaatgtctaacatcaataatagtaactcacatttattgagttattactgtatgccagacactattctttgagctttaaattgataattcatttaatcctcatgataaatctgtgagatagttatctttatttctgtttgaatgttgaagaaattgtagcactgagagcctggatcactcgcttcagttcatacagctagtaaaatggggagccacaactcttacccgagcagtctgtctgcagagtctgttatctcatgagaagataaatgctttaaaaagataacaatgaaaatattaatgattcgagtataatctgggacatcccaggcaacttgagcagtagagggttccaggagagcaaattctaggtactcgtatgataggctggggaatcagctgtgcaatggccctgaagtgcaaagaattagggctttcatggcaaaacaccagtggccaaagcaaggtagagagaaagcagttttgcaacaaagaggcataatcaaattagttcatttcataaatactttttagccctcaggagacagtatgaaaaaatacccataatccctgctgttaaagagggaggaaacagaaataaaccaagcactcagcaaatgagtaataagttagttatttatgaagtccagtggtgaaaaaggacacagggtaggggcactggggctccagttagggtaggctgagctaataagctgccatttgacaaagatgtgagagaatgagccttaagggtatctagggacatatgtttaggcagagacaactgaaagtgcaaaggccctaagcttgtgtgggtggacaccttgacttttctctaaaaatacaagactgctttaggtctttgcttcagtgtcaccttctcagtgatttacctatttacagttgcaatcccttccctatctgagcactccctgtccccttctctgcgtgtcccatatctggaatatgatatattttatgtaatgggtattgtctgtttttccctactagaatgtcagcttaaaatggacaagtgtttttgttttttattagtactatatccaaattcccagaacagtgtctcatatatattaaatactttacatatgtatgaaatgaatttattaaggtttataatactcttatgatgttatctccatcttattggtggaaagagtgagccacgcaacaggtaactcatggcaaaataaatgatgagctctttaatgtgaatgttgatagtcatcctcatcatgacagagtgtgacatacgtgctggaatgcgtgggcaggactgcacagtcagaagacctggatgggaagaatttcagttgattatgtcagttgagatgagtcaatatctctgtcttcctatctgacatgattattttcaggatcaaataggacagcattatatgaaatatgacagtgcttggcatagaggatgtgcttgataaatgtcgctgattctgaattccaaatagttaatggatataaaatctaatttttatttttgctggcacagccttcatggttcagatgatctctaaaaagtttattcttaattgctacatttggaacattctagttatccatgagactgtgtttgaagtacaacaatttgtggtattcacctaaatggctcagttcaaccaatgggtgattacagtgtgtcaggccctgtgctaaatgctagggaaacaaacatactggctctgaccttctggcagagagcttagagaatagtattacagtataaaaagagtaaaacttcataatatgaatagaatacatgacatattgtgagagaggtctaaataaggggttctgagatgtaaagatgggacattgagtccagccctaggagcccaggggttcagagaagcctccctaaaagagtacctgaataatcttaagtgcgagtagcagcagctaaaataggaatgaatgtaacagagagaaaagcaaaggcagagaggcatctaatagtatgctgtgcatggcaaggaaagccagatgctcactcagtgtttctagggcataacattgaggcaagggggatatgtgaaataaataggtaaggaacagctcatgaagagcctgtgtgctatgcagggaggcatggtctttatgctagaagcagatgataggaaaccattgaagggctcaaagcaggaactccgtggtctgatagacacagcttatttttctcaatgtccttaacccattattggaaaaataaacatatatcaaatctccctgttctctttcctcgtagttcttcctaatatgctatttatttgctaaagctttcatatctcaagacctcaccatatggttcaaacgatatgatattcccattcccatgaatgtatatttaatttaattataaattgccaatttaatctctctctatattttgcagaatgtaacagaatctggatgcaaagaatgtgaggaactggaggaaaaaaatattaaagaatttttgcagagttttgtacatattgtccaaatgttcatcaacacttcttgattgcaattgattctttttaaagtgtttctgttattaacaaacatcactctgctgcttagacataacaaaacactcggcatttcaaatgtgctgtcaaaacaagtttttctgtcaagaagatgatcagaccttggatcagatgaactcttagaaatgaaggcagaaaaatgtcattgagtaatatagtgactatgaacttctctcagacttactttactcatttttttaatttattattgaaattgtacatatttgtggaataatgtaaaatgttgaataaaaatatgtacaagtgttgttttttaagttgcactgatattttacctcttattgcaaaatagcatttgtttaagggtgatagtcaaattatgtattggtggggctgggtaccaatgctgcaggtcaacagctatgctggtaggctcctgccagtgtggaaccactgactactggctctcattgacttccttactaagcatagcaaacagaggaagaatttgttatcagtaagaaaaagaagaactatatgtgaatcctcttctttatactgtaatttagttattgatgtataaagcaactgttatgaaataaagaaattgcaataactggcatataatgtccatcagtaaatcttggtggtggtggcaataataaacttctactgataggtagaatggtgtgcaagcttgtccaatcacggattgcaggccacatgcggcccaggacaactttgaatgtggcccaacacaaattcataaactttcatacatctcgtttttagctcatcagctatcattagcggtagtgtatttaaagtgtggcccaagacaattcttcttattccaatgtggcccagggaaatcaaaagattggatgcccctggtatagaaaactaatagtgacagtgttcatatttcatgctttcccaaatacaggtattttattttcacattctttttgccatgtttatataataataaagaaaaaccctgttgatttgttggagccattgttatctgacagaaaataattgtttatattttttgcactacactgtctaaaattagcaagctctcttctaatggaactgtaagaaagatgaaatatttttgttttattataaatttatttcaccttaattctggtaatactcactgagtgactgtggggtgggaaatgatctcttaagaatttgatttctttctattccatagtacaaactcgttctctgttgaaacattcttctatcaccccagtgccctatccatgtacatgtgttcttattgctctagtcaaacggtgcttataaatatctttcagaaagcttaggagaaatctgtatcctatttgacttccaataatcacggattgggatcggacctacttgattcacttctgggaaatcaaggatctacgtaccatggattttcaggtgcagattttcagcttcctgctaatcagtgcctcagtcataatgtctagagccaactgggtgaatgtaataagtgatttgaaaaaaattgaagatcttattcaatctatgcatattgatgctactttatatacggaaagtgatgttcaccccagttgcaaagtaacagcaatgaagtgctttctcttggagttacaagttatttcacttgagtccggagatgcaagtattcatgatacagtagaaaatctgatcatcctagcaaacaacagtttgtcttctaatgggaatgtaacagaatctggatgcaaagaatgtgaggaactggaggaaaaaaatattaaagaatttttgcagagttttgtacatattgtccaaatgttcatcaacacttcttgattgcaattgattcctcgag

SEQ ID NO: 2913 - DNA, 1610 bp; single-stranded, linear
cccagagcagcgctcgccacctccccccggcctgggcagcgctcgcccggggagtccagcggtgtcctgtggagctgccgccatggccccgcggcgggcgcgcggctgccggaccctcggtctcccggcgctgctactgctgctgctgctccggccgccggcgacgcggggcatcacgtgccctccccccatgtccgtggaacacgcagacatctgggtcaagagctacagcttgtactccagggagcggtacatttgtaactctggtttcaagcgtaaagccggcacgtccagcctgacggagtgcgtgttgaacaaggccacgaatgtcgcccactggacaacccccagtctcaaatgcattagagaccctgccctggttcaccaaaggccagcgccaccctccacagtaacgacggcaggggtgaccccacagccagagagcctctccccttctggaaaagagcccgcagcttcatctcccagctcaaacaacacagcggccacaacagcagctattgtcccgggctcccagctgatgccttcaaaatcaccttccacaggaaccacagagataagcagtcatgagtcctcccacggcaccccctctcagacaacagccaagaactgggaactcacagcatccgcctcccaccagccgccaggtgtgtatccacagggccacagcgacaccactgtggctatctccacgtccactgtcctgctgtgtgggctgagcgctgtgtctctcctggcatgctacctcaagtcaaggcaaactcccccgctggccagcgttgaaatggaagccatggaggctctgccggtgacttgggggaccagcagcagagatgaagacttggaaaactgctctcaccacctatgaaactcggggaaaccagcccagctaagtccggagtgaaggagcctctctgctttagctaaagacgactgagaagaggtgcaaggaagcgggctccaggagcaagctcaccaggcctctcagaagtcccagcaggatctcacggactgccgggtcggcgcctcctgcgcgagggagcaggttctccgcattcccatgggcaccacctgcctgcctgtcgtgccttggacccagggcccagcttcccaggagagaccaaaggcttctgagcaggatttttatttcattacagtgtgagctgcctggaatacatgtggtaatgaaataaaaaccctgccccgaatcttccgtccctcatcctaacttgcagttcacagagaaaagtgacatacccaaagctctctgtcaattacaaggcttctcctggcgtgggagacgtctacagggaagacaccagcgtttgggcttctaaccaccctgtctccagctgctctgcacacatggacagggacctgggaaaggtgggagagatgctgagcccagcgaatcctctccattgaaggattcaggaagaagaaaactcaactcagtgccattttacgaatatatgcgtttatatttatacttccttgtctattatatctatacattatatattatttgtattttgacattgtaccttgtataaacaaaataaaacatctattttcaatatttttaaaatgca

SEQ ID NO: 2914 - DNA, 393 bp; single-stranded, linear
atgcctgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcccctcaccattaacaggattttcaaaggagcagcctcagaacaaagtgagacagtccagcctggagatgaaatcttgcagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctag

SEQ ID NO: 2915 - DNA, 3175 bp; single-stranded, linear
tgcttaaaaaaacacaacaggattttcgaagaatcctttcttagaaaacaaacaaaaaaaccaaacaaaaacgtactttctccccactagtttacaccacaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagagccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactttcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggcaggggcatctccaacatcatcatccaacgaagactcagctgcaaatggttctgctgaaacatctgccttggacacggggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttgcagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacactggggcagctgatacaaattgcagactgtgtaaaaagagagcttaatgataatattgtggtgccacaaataaaatggatttattagaattccatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacctgagatcattcactcatacatctggccgttgatgttggctgggaactcacctggggctgctggcctgaatgcttataggtggcctctccttgtggcctgggctcctcacaacatggtgtctggattcccaggatgagcatcccaggatcgcaagagccacgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaatagaggagtacaggtgaagcaccaagctcaaagcgtggacaggtgtgccgacagaaggaaccagcgtgtatatgagggtatcaaataaaattgctactacttacctacc

SEQ ID NO: 2916 - DNA, 3568 bp; single-stranded, linear
atgcctgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcccctcaccattaacaggattttcaaaggagcagcctcagaacaaagtgagacagtccagcctggagatgaaatcttgcagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctagtgcttaaaaaaacacaacaggattttcgaagaatcctttcttagaaaacaaacaaaaaaaccaaacaaaaacgtactttctccccactagtttacaccacaggaagcgagagagctgctgccactgctgctaccacaggaagacacagcagggagaagccctagtgcctctgccggctgcccaggacctggtatcggcccacagaccaagtcctccacagagggcgagccagggtggagaagagccagcccagtgacccaaacatccccgataaaacacccactgcttaagaggcaggctcggatggactatagctttgataccacagccgaagacccttgggttaggatttctgactgcatcaaaaacttatttagccccatcatgagtgagaaccatggccacatgcctctacagcccaatgccagcctgaatgaagaagaagggacacagggccacccagatgggaccccaccaaagctggacaccgccaatggcactcccaaagtttacaagtcagcagacagcagcactgtgaagaaaggtcctcctgtggctcccaagccagcctggtttcgccaaagcttgaaaggtttgaggaatcgtgcttcagagccaagagggctccctgatcctgccttgtccacccagccagcacctgcttccagggagcacctaggatcacacatccgggcctcctcctcctcctcctccatcaggcagagaatcagctcctttgaaacctttggctcctctcaactgcctgacaaaggagcccagagactgagcctccagccctcctctggggaggcagcaaaacctcttgggaagcatgaggaaggacggttttctggactcttggggcgaggggctgcacccactcttgtgccccagcagcctgagcaagtactgtcctcggggtcccctgcagcctccgaggccagagacccaggtgtgtctgagtcccctcccccagggcggcagcccaatcagaaaactttcccccctggcccggacccgctcctaaggctgctgtcaacacaggctgaggaatctcaaggcccagtgctcaagatgcctagccagcgagcacggagcttccccctgaccaggtcccagtcctgtgagacgaagctacttgacgaaaagaccagcaaactctattctatcagcagccaagtgtcatcggctgtcatgaaatccttgctgtgccttccatcttctatctcctgtgcccagactccctgcatccccaaggcaggggcatctccaacatcatcatccaacgaagactcagctgcaaatggttctgctgaaacatctgccttggacacggggttctcgctcaacctttcagagctgagagaatatacagagggtctcacggaagccaaggaagacgatgatggggaccacagttcccttcagtctggtcagtccgttatctccctgctgagctcagaagaattaaaaaaactcatcgaggaggtgaaggttctggatgaagcaacattaaagcaattagacggcatccatgtcaccatcttacacaaggaggaaggtgctggtcttgggttcagcttggcaggaggagcagatctagaaaacaaggtgattacggttcacagagtgtttccaaatgggctggcctcccaggaagggactattcagaagggcaatgaggttctttccatcaacggcaagtctctcaaggggaccacgcaccatgatgccttggccatcctccgccaagctcgagagcccaggcaagctgtgattgtcacaaggaagctgactccagaggccatgcccgacctcaactcctccactgactctgcagcctcagcctctgcagccagtgatgtttctgtagaatctacagcagaggccacagtctgcacggtgacactggagaagatgtcggcagggctgggcttcagcctggaaggagggaagggctccctacacggagacaagcctctcaccattaacaggattttcaaaggagcagcctcagaacaaagtgagacagtccagcctggagatgaaatcttgcagctgggtggcactgccatgcagggcctcacacggtttgaagcctggaacatcatcaaggcactgcctgatggacctgtcacgattgtcatcaggagaaaaagcctccagtccaaggaaaccacagctgctggagactcctaggcaggacatgctgaagccaaagccaataacacacagctaacacacagctcccataaccgctgattctcagggtctctgctgccgccccacccagatgggggaaagcacaggtgggcttcccagtggctgctgcccaggcccagaccttctaggacgccacccagcaaaaggttgttcctaaaataagggcagagtcacactggggcagctgatacaaattgcagactgtgtaaaaagagagcttaatgataatattgtggtgccacaaataaaatggatttattagaattccatatgacattcatgcctggcttcgcaaaatgtttcaagtactgtaactgtgtcatgattcacccccaaacagtgacatttatttttctcatgaatctgcaatgtgggcagagattggaatgggcagctcatctctgtcccacttggcatcagctggcgtcatgcaaagtcatgcaaaggctgggaccacctgagatcattcactcatacatctggccgttgatgttggctgggaactcacctggggctgctggcctgaatgcttataggtggcctctccttgtggcctgggctcctcacaacatggtgtctggattcccaggatgagcatcccaggatcgcaagagccacgtagaagctgcatcttgtttatacctttgccttggaagttgcatggcatcacctccaccatactccatcagttagagctgacacaaacctgcctgggtttaaggggagaggaaatattgctggggtcatttatgaaaaatacagtttgtcacatgaaacatttgcaaaattgtttttggttggattggagaagtaatcctagggaagggtggtggagccagtaaatagaggagtacaggtgaagcaccaagctcaaagcgtggacaggtgtgccgacagaaggaaccagcgtgtatatgagggtatcaaataaaattgctactacttacctacc

SEQ ID NO: 2917 - DNA, 9203 bp; single-stranded, linear
gaattcatgccacaactgagtgattttttttttctcaaacccaattccacaaagtaaaagcctgatgaaatacagtgaaggctgatgcttattaactgtgtttcccaaatccagagctctaaaaaggttctgcatacagtcattcattcaatgcttaacgactgagcattaattccatgctaagtactgaactcagcactaggaataagaaggcgacctagaggcatatcctctctctaaagatgcatagagcctcattggaatgatcagccgtgtctccagagagctacaaggcagttttcaattggtaaatgccctgagagtgatgggcttgtggcatgtgtaagggttagacagacctgggacctagacatgacaccactcctgacgaattatgtgagtgtgggtgtttcacaaccacaatgagatgcaatgcctgcacttgtaacatggaaatagtgatggcatgccccgcagattgctgtgagaagtcagcggcagagacatgcaacattctcagcacagtgcttgccatgtagtaagggcctagtcagtgctagtgattcctttcaatattcctaagatgcagataagggaacagcccagaggagggggagcacttccagagggaggaatgcggtgagacttccttcagcagggtagcactggagctgggtgttaaggagtgagtgagctttgggcttatggatttaacagaggaaaccaagaaaagaggaggcggtgttgcaggaacagtgagcagttgatgatttttattttgttctctggtctgcttgggaacatttttgtggcaaagacagcatgaaggatagcgaagaattaatactgaagagataggccagggcaggttatgaaggattttgaataccgggctaagaaatgtgggcttaatttcaaagacattatggacactcctaaaatgttacgttgtagataagggaaaagtattcttccagaagattaaattggggctgggcacggtggctcacgcctgtgatcccagcactttgggaggcgaagtgggcagatcacctgaggtcaggagtttgagatcagcctggccaacgtggtgaagccccatctctactgaaaaaaaaaattagccgggcatggtggtgggtgcctgtaatctcagctacttgggaggctgaagcaggagaatcacatgaacctgggaggcagaggttgcagtgagccaagattgcaccactgcattccagtgggcgacagagcaagactcagtcaaaaaaaaaaaaagattaaactggaagcaatgggtaagaatggtggagtggagagacacatttgagtgagggaagccagctgaaaagctgtacagacgtctagacaaaatgtgacacaagcatgccttcacctccctgcaaagaccacagaccactgagctccaaagggggtttggaatccttgtcctgggccgccattggtaactcatcagtgctggcttgagagataaactctattatccatccctgaactaaaatcatgacagaagtggccagggagctttgctgctatccccccaggaaacacgtcctccactcaaatggaaagaggaccctctgacaacatctgtgggacccaacagcactggtcaccacaagccacaaaatgttaacaaagtcagttttcaattgttagggacggaggactcagttcatgattcatacaaaccaactgttctctcccagtgttttctgggtggcacaacccacaagtcaacagtggcttgggaactagacatttgagtagagttgggttatttgattcatagtggattttggttttccacgggacccctgtgcccttgtctagtagaatctggtggaaattacaaactgcagaaattcaactcagtgccgcaataacaggatgcacctgtagatttcgtagaattagcagcagcattctttcaataccagtttgagagaaataaccctgtttgcatagtgccaactggggcagaatctgaagtgtcttgcctgcctctcggccatgggaggcaccgatctcagcaacatctatccaaccgccatccacttaacaagcaaagatggaaggccctcgtgctccaggctatcctgcaatggttcatttgcttttgatgggattatcactttgacagatgtgcttgcaattaactgggggctttctgcttccaatccaaattcccacaggtggatcactggctcttggggagcaaaaacccttctttgtttgtttttgcttctcccagagcctgggcagagctccccattcctggatcctacgttgatatgcactgaattgaattatactaaagggtgcacccaagagtgcatgagctaagtaaaatgtaatttgtgggacctcatgtggacatttcaggtccatgtgtacaagataaaggagagaaaatcctgggggacaccacaggcctgggaaaatgacctcctactaagcctaacaagaacatccagtacataaacagcaggctctctgcaaccgcttcggtccttccactgccacgctcccagaaagcaaagggttatctcctgttcggattttggctctgagaccacagctcagcacatcactcctctagagaaaagaaagtctaagatgagagagtgaggctgctttcatgtggtgccagcgtatagtgcagggcaggcctgattgctgaacggatccctgcagacgtgagcggtcacttccccttttgagggcccatttcttttcctctttgaggagactgtgagcgtcctcagtgcagggctatgttttagcttcttggctctcctcacaggttctagcataattctttgattaattgcagtcaacgtttattgatggattatgtgacagaggtgaaattctttgatctgggtttcagcttttcctttcccccactccctcctttttctttttttttttttttttttttagaggcgaggtcttgctctgtggccctggctggagtgcagtggtgcaatcatagctcattgcagccttgacctcctggggtcaagcgaacctcaacgtcttggcctcctgagtagctgggactataggcatgcgccaccacgctcagcttcaccttttcctttccttgtgctcccctggcagatatgctggtaaacaatgaaccagtcaagaggacagcaacaggaggaaaatgggagaaaccccattattcgtggactaaacaggcttcccactagtcctggctcacagaggaagtcatgctccatgtttcaaatgtcctcaaagctcgttcaactccaaaatgcatgaagacaaaatgggaattttactcaagatttttgtgggctgttggggagaagagttaacattgcaaagcatattgcaaactcttatcttcaaatgattttaaaattttcttccaagctctttattatttctccagagctgccctgctcttcccactctgggtcctttctctgccactctcctcagcatgacttctccctaatcggccagcatttcttttattctatagagcaagttttcttgccctgggcacctctcatttgcatgttataccaccacaccaagtgagcctcagagcaccagtgttttaatccctgaaaacagtccttacgggattcagcacagaggtcctcttggcagcctgtagtctccagagtgacacgtcctcaacagtcaaagtgagcaagctatggtgcccatcaccaagtggggctcaccatttccctctgcgttcacttctctcctaccttcttccttatcccatccttcctccttcctttttttttctgcattcaattattcatggttattcatttcatacgggcatctgtgccacttggttctacaggcatttttttttttgagacagacttttgcccttgtcccccaggctggcgtgcagcggtgtgatcttggctcactgcaatctccacctcctaggttcaagcaagtctcctgccttagcctcccaagtagctggaattacaggcatgtgccaccaagcccggcaaatttttgtatttttagtagagacagggtttcaccatgttggccaggctggtctcaaactcctgacctcaggtgatctgcctgcctcggcctcccaaagtgctgggataacaggcgtgagccatcgtgctcggccggttctatgggcattgtggaagtgaccgttaacaagccccaagggtaagtaaaggaaaatgaaaggtgattgattcctcaccacctctccccttttttcctctactctttgcccctgctccccaatctagactctaataaacagaaatgatttttgttgcaagctgaaaactcgttcttgtggttggggctaggggggtggcaagtcaagctttagagttgtctggataataaatgctgtcttcaaggactgtccaacattgtaggaacaagagaacaacccaagtgaacaactaactcctgttcacaaatgctactgcctctctgccatcccctaacctcagcctcacacacttgaatttcgccaatccatttgatgagctcaaatcagtgaattttctcctcgccaaagctcacaaattctgttccccgcttcttgccccacatccaggcattaccaactgcattttccctttgcctgatattctggcatcaagcctccttgccattccaatttatttcaccttcctccagtccttatgatttccttcctgaagagtatttcagcatctctatgcctcaatcttccctgcacaccacaccagctcggcctcatcatcacattacttggctatgtcccgcctgggttagacagcttcagtggctgaagtccatagatcttattctgtttttcgaggtccacctgactctgaatccagctgacatttctgcccttagcttctacccctctctacttctggttaactatggaccacactctgcttcctcaggaaccacctaccaaggccgtatccatccttcaaggacaatacgtgggcctttcctgatcacatcagctcaacaacttttccctcctacatttcaattgctcttcttaccataatcattagtattcaccccactgtacgtctagaaagaaagtggtcttaaacctaagggaaggcagtctaggtcagaaatttgttgtccgctgttctgagcagtttcttctaggaagtaccaaacatttctgataatagaattgagcaatttcctgatgaagtgagactcagcttgcactgttgaccggctgtcctggatgaacctagttacttttaaccaaatgttcctttcttgaacttgttcctttcttgaacttaatctatcaatgttatctagataactttcctcaaaaaaaaaaaaaaaaaaaaaaaccctctactaggaaagaaatctttgaaccggacttattggaaattacctccttgcagcaggtttgaaacaaaactttgaatttgcctcacaaagaatttgtctgaaactgctttagtatatgctagttatatttgtatgcacatgtggcttcatacatagtggttggacacccatatgtgttatgcactttgttaggtgacgtaagttcacagataaactggaacatagggctatcctctagaggcccacagtttgacaccttaacctgagatccttggacctttgaagttcagagtgcccacaaccgctgggtgtggtggctcacacttgtaatcccagtactctgcagggctgaggtgggaggatcgcttgagtccaggagtctgagaccagcctgggcaacatgacaaaaccccatctctacaaaaattacaaaaaaaattagccaggcctggtggtgcatgcctgtggtcccagttacttgagaggctgaagtgggaggatcacttgagtcaaggaggtagaggctgcagtgagttgagatggcaacactgcactccagaaaccccatctcaaacaaaacagagcaaaacaaaacaaactgcccataatgctcctgaaacttcctacggatttatccagagtatgtgctgatgtgcattttttccaaggagggaaaccaaaggttctatcaaattaagaaaagagtttttaccattgtggaagacagtatggcgattcctcaagcatctaaaatcagaaataccatttgacccagcaatcctattactgggtatatacccaaaggaatagaaatcattctactataaagtcacatgcaaccgtatgtttattgcagcactatttacaatagcaaaatggaaccaactgaaatgcccatcaatgagactagataaagaaaatgtgatacatatacaccatggaatactatgcagccatgaaaaggaatgagatcacgtccttggcagggacatggatgaagctggaagccattatcctcagcaaactaacacaggaacagaaaaccaaatgccgcatgttctcactcataagtgggagttgaacaatgacagcacatagacatagggaggggaacatcacacgccagggcctgctgcagggtggggggtggggtgtgaggggagggaacttagaagacaggtgagtaggtgcagcagaccaccatggcacacttatacctatgtaaccaacctgcacgttctacacatgtatcctggaacttaaattaaaaacaaaaaagagtttttaatccaagaaagattaacagcaactagaagaaagaaagagatataaacagtgaattgcaatgcagcacggcaggtgttatgatggagtagaaaggactggaaaaggcctcctggaggaagggacactcaagtgtctttccatttcacctgtaaactcattaagggcaaaagctttgctacagcttcagtatgagatcctgggcaatccgtgacaaaatgggtctgcttttgcacccccaacttcttctcacatccctgcatcgtgccatgcagcatcaactggaaacctcagcgtcagcaaacgacgacagagcgttcatccgtaaggtgaaccagaaaagccagttcaatgacttgtttaaccatggtccatctcagaaccaagagttgggcctcttatttaccagaaaaattgtgggggctttgtgatatggctttaaaaaaatcttgtaattgccaggcgtggtggctcacacctgtaatcccagcactttgggaggccgaggtgggtgaatcgcctaaggtcaggagttcgagaccagcctgaccaacatggtgaaactccgtctctactaaaaatacaaaaactagctggatgtggtgacgcgtgcctgtaatcctagctactcaggaggctgacgcaggagaatcacttgaacctgggaggcagaggttgcagtgagccaagattgtgccattgcgctccaaaaaaaaaaaaaaaatacattaacataaatttaaatattttataatgacaatccacattaactacttaaagcataagctattttccaggagaggcagcaagtgcattctactcccatgcccaagaagaaaggagcgtgactttggtgggagtactaggagtttctactggagcacttgcccgcagagtgagaaacgttcctagagaggaagttatacctgctgtggaatttaagagaatcttgtcatattttgacaagttttttgagatggaagtctcactctgtcgcccaggctggagtgcagtggcgcaatctcagctcactgcagcctgcacctcctcggttccagctattctcttgtctcagcctcctgagtaactgggattacaggcgcccgccactacgcctggctaatttttgtatttttagtagaaatggggttttaccatgttggccagactggtctcaaactcccgacctcaggtgatctgcctgcctcagcctcccaaagtgctggaattacaggcgtgtgccactgcgcctggctaatttttttttttttttttttttagtagagacggtggtttcaccatgtcatccaggctggtctcaaactcctgacctcaggtgatccacccaccttggtctaccaaagtgctcggattacaggcatgagccaccaggcccagtcaacgtgatgtgttttggaaccctgaattccttggcttgccggagggttttctttttgttaatatctttgcttgctttctagtatttaaaaaattgtgttttgctctaactatgcaatggctttaagtcttagacaaatttccagggagcaaaacacactcaaccaatttcataataatcagaagagagctctgatcaataaataagcaagactgaattttacaaaataatccaaagtttaaaaccaaagcccactttttgcatgatcctttaagagaaagaaatctggaagcaaaacaccttataaaatgacaatgcactttcaggagcccagggcactgtggtgaaatgatgatggctagtacaggttataagccttggggaattatttatgaattctcaggatccttcagttcgccgcatccttctccattatttgaatattggaggctgcctgaccagaatcttgtcaggactttgctccttcatcccaggtggtcccggctgactcctgaggacgttacagccctgaggggaggactcagcttatgaagtgctgggtgagaccactgccaagaagtgcttgctcaccctaccttcaacggcaggggaatctccctctccttttatgggcgtagctgaagaaaggattcataaatgaagttcaatccttctcatcaaccccagcccacacctccagcaattgaacttgaaaaaaaaaacctggtttgaaaaattaccgcaaactatattgtcatcaaaaaaaaaaaaaaaaaaacacttcctatatttgagatgagagaagagagtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcaggtaagggcctgtgggtgcccccggaattc

SEQ ID NO: 2918 - DNA, 2335 bp; single-stranded, linear
gaattccccccccccccccccgagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagggaattc

SEQ ID NO: 2919 - DNA, 1092 bp; single-stranded, linear
gaattcatggaaatgggaagggcagtgatggagatgggaagggcagtgggggttggaggggtggggattgttgttgggtacgaaaacagaattagatcgaatgaataagatctagtatttgatagcataacagggtgactttagtcaacaataatttattgtacatttaaaaataactaaaagagtatacttggattttaacacaaagaaaggataaatacttgaggtgatggataccccatttaccctgatgtgattattatacattgtatgcctgtatcaaaatagctcatgtgcctcatgaatatagacacctaccacatgcccacaaaattaaaaactaaaaaaaacagtcatctctgaatgctaaacggagtaaggggcttcctggaaggctgggtgaaatgggagtctcggaaagatggtgtgttgcaggctgggaggagggtgagacgctggggtcacctagagggacctgcttgtgtgaagcctacgtattagtgggtatgtgtgtgaccggatggaggcgtcagaggtgttgggtagcctgtgtgagttggcgtgggggtgatgtaggaggggagagagggagggcctgcgttcccttggctcctgtgtgcagctaggcccctatttgacaatgtgtgtctgtgtgtgtgtgtgtgtgtgtgtgtgtgtgtgtgtgccgcccccagcgtaggaggcagatctttatctggccctgggtgcttgaggagtttcaggctttctcataagcctcgtctccccgcctctccaccccaggccttgcccctctatcctctgcacaggaagtgggctggctctgggcttttagtctttgcggccccagcagccagagctcagcagggccctggagagatggccacggtcccagcaccggggaggactggagagcgcgcgctgccaccgccccatgtctcagccaggtgatgtccccctgcctccctcccggcccctgtggaccagccagagggctgggagtgaaagtcacagagaagactttcagctctgactcagttcccccagcagtttctgcctgaactcccatcccccaactttgtcttagaattc

SEQ ID NO: 2920 - DNA, 1451 bp; single-stranded, linear
gaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatc

SEQ ID NO: 2921 - DNA, 1563 bp; single-stranded, linear
gagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtgaagagaagcctcaggcaagccccgaaggccgtcctgagagtgagacttcctgcctcgtcacaacaacagattttcaaatacagacagaaatggctgcaaccatggagacgtccatatttacaacagagyaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttccactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctt

SEQ ID NO: 2922 - DNA, 733 bp; single-stranded, linear
gaattctcaggatccttcagttcgccgcatccttctccattatttgaatattggaggctgcctgaccagaatcttgtcaggactttgctccttcatcccaggtggtcccggctgactcctgaggacgttacagccctgaggggaggactcagccttatgaagtgctgggtgagaccactgccaagaagtgcttgctcaccctaccttcaacggcaggggaatctccctctccttttatgggcgtagtgaagaaaggattcataaatgaagttcaatccttctcatcaaccccagcccacacctccagcaattgaacttgaaaaaaaaaacctggtttgaaaaattaccgcaaactatattgtcatcaaaaaaaaaaaaaaaaaaacacttcctatatttgagatgagagaagagagtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcaggtaagggcctgtgggtgcccccggaattc

SEQ ID NO: 2923 - DNA, 756 bp; single-stranded, linear
gagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcaaggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcagagacagaggaagagtagaagaacaatctag

SEQ ID NO: 2924 - DNA, 711 bp; single-stranded, linear
gaattctcaggatccttcagttcgccgcatccttctccattatttgaatattggaggctgcctgaccagaatcttgtcaggactttgctccttcatcccaggtggtcccggctgactcctgaggacgttacagccctgagggaggactcagcttatgaagtgctgggtgagaccactgccaagaagtgcttgctcacctaccttcaacggcaggggaatctccctctccttttatgggcgtagctgaagaaaggattcataaatgaagttcaatccttctcatcaccccagcccaacctccagcaattgaacttgaaaaaaaaaacctggtttgaaaaattaccgcaaactatattgtcatcaaaaaaaaaaaaaaaaaaaaacacttcctatatttgagatgagagaagagagtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcaggtaagggcc

SEQ ID NO: 2925 - DNA, 17844 bp; single-stranded, linear
gaattcatgccacaactgagtgattttttttttctcaaacccaattccacaaagtaaaagcctgatgaaatacagtgaaggctgatgcttattaactgtgtttcccaaatccagagctctaaaaaggttctgcatacagtcattcattcaatgcttaacgactgagcattaattccatgctaagtactgaactcagcactaggaataagaaggcgacctagaggcatatcctctctctaaagatgcatagagcctcattggaatgatcagccgtgtctccagagagctacaaggcagttttcaattggtaaatgccctgagagtgatgggcttgtggcatgtgtaagggttagacagacctgggacctagacatgacaccactcctgacgaattatgtgagtgtgggtgtttcacaaccacaatgagatgcaatgcctgcacttgtaacatggaaatagtgatggcatgccccgcagattgctgtgagaagtcagcggcagagacatgcaacattctcagcacagtgcttgccatgtagtaagggcctagtcagtgctagtgattcctttcaatattcctaagatgcagataagggaacagcccagaggagggggagcacttccagagggaggaatgcggtgagacttccttcagcagggtagcactggagctgggtgttaaggagtgagtgagctttgggcttatggatttaacagaggaaaccaagaaaagaggaggcggtgttgcaggaacagtgagcagttgatgatttttattttgttctctggtctgcttgggaacatttttgtggcaaagacagcatgaaggatagcgaagaattaatactgaagagataggccagggcaggttatgaaggattttgaataccgggctaagaaatgtgggcttaatttcaaagacattatggacactcctaaaatgttacgttgtagataagggaaaagtattcttccagaagattaaattggggctgggcacggtggctcacgcctgtgatcccagcactttgggaggcgaagtgggcagatcacctgaggtcaggagtttgagatcagcctggccaacgtggtgaagccccatctctactgaaaaaaaaaattagccgggcatggtggtgggtgcctgtaatctcagctacttgggaggctgaagcaggagaatcacatgaacctgggaggcagaggttgcagtgagccaagattgcaccactgcattccagtgggcgacagagcaagactcagtcaaaaaaaaaaaaagattaaactggaagcaatgggtaagaatggtggagtggagagacacatttgagtgagggaagccagctgaaaagctgtacagacgtctagacaaaatgtgacacaagcatgccttcacctccctgcaaagaccacagaccactgagctccaaagggggtttggaatccttgtcctgggccgccattggtaactcatcagtgctggcttgagagataaactctattatccatccctgaactaaaatcatgacagaagtggccagggagctttgctgctatccccccaggaaacacgtcctccactcaaatggaaagaggaccctctgacaacatctgtgggacccaacagcactggtcaccacaagccacaaaatgttaacaaagtcagttttcaattgttagggacggaggactcagttcatgattcatacaaaccaactgttctctcccagtgttttctgggtggcacaacccacaagtcaacagtggcttgggaactagacatttgagtagagttgggttatttgattcatagtggattttggttttccacgggacccctgtgcccttgtctagtagaatctggtggaaattacaaactgcagaaattcaactcagtgccgcaataacaggatgcacctgtagatttcgtagaattagcagcagcattctttcaataccagtttgagagaaataaccctgtttgcatagtgccaactggggcagaatctgaagtgtcttgcctgcctctcggccatgggaggcaccgatctcagcaacatctatccaaccgccatccacttaacaagcaaagatggaaggccctcgtgctccaggctatcctgcaatggttcatttgcttttgatgggattatcactttgacagatgtgcttgcaattaactgggggctttctgcttccaatccaaattcccacaggtggatcactggctcttggggagcaaaaacccttctttgtttgtttttgcttctcccagagcctgggcagagctccccattcctggatcctacgttgatatgcactgaattgaattatactaaagggtgcacccaagagtgcatgagctaagtaaaatgtaatttgtgggacctcatgtggacatttcaggtccatgtgtacaagataaaggagagaaaatcctgggggacaccacaggcctgggaaaatgacctcctactaagcctaacaagaacatccagtacataaacagcaggctctctgcaaccgcttcggtccttccactgccacgctcccagaaagcaaagggttatctcctgttcggattttggctctgagaccacagctcagcacatcactcctctagagaaaagaaagtctaagatgagagagtgaggctgctttcatgtggtgccagcgtatagtgcagggcaggcctgattgctgaacggatccctgcagacgtgagcggtcacttccccttttgagggcccatttcttttcctctttgaggagactgtgagcgtcctcagtgcagggctatgttttagcttcttggctctcctcacaggttctagcataattctttgattaattgcagtcaacgtttattgatggattatgtgacagaggtgaaattctttgatctgggtttcagcttttcctttcccccactccctcctttttctttttttttttttttttttttagaggcgaggtcttgctctgtggccctggctggagtgcagtggtgcaatcatagctcattgcagccttgacctcctggggtcaagcgaacctcaacgtcttggcctcctgagtagctgggactataggcatgcgccaccacgctcagcttcaccttttcctttccttgtgctcccctggcagatatgctggtaaacaatgaaccagtcaagaggacagcaacaggaggaaaatgggagaaaccccattattcgtggactaaacaggcttcccactagtcctggctcacagaggaagtcatgctccatgtttcaaatgtcctcaaagctcgttcaactccaaaatgcatgaagacaaaatgggaattttactcaagatttttgtgggctgttggggagaagagttaacattgcaaagcatattgcaaactcttatcttcaaatgattttaaaattttcttccaagctctttattatttctccagagctgccctgctcttcccactctgggtcctttctctgccactctcctcagcatgacttctccctaatcggccagcatttcttttattctatagagcaagttttcttgccctgggcacctctcatttgcatgttataccaccacaccaagtgagcctcagagcaccagtgttttaatccctgaaaacagtccttacgggattcagcacagaggtcctcttggcagcctgtagtctccagagtgacacgtcctcaacagtcaaagtgagcaagctatggtgcccatcaccaagtggggctcaccatttccctctgcgttcacttctctcctaccttcttccttatcccatccttcctccttcctttttttttctgcattcaattattcatggttattcatttcatacgggcatctgtgccacttggttctacaggcatttttttttttgagacagacttttgcccttgtcccccaggctggcgtgcagcggtgtgatcttggctcactgcaatctccacctcctaggttcaagcaagtctcctgccttagcctcccaagtagctggaattacaggcatgtgccaccaagcccggcaaatttttgtatttttagtagagacagggtttcaccatgttggccaggctggtctcaaactcctgacctcaggtgatctgcctgcctcggcctcccaaagtgctgggataacaggcgtgagccatcgtgctcggccggttctatgggcattgtggaagtgaccgttaacaagccccaagggtaagtaaaggaaaatgaaaggtgattgattcctcaccacctctccccttttttcctctactctttgcccctgctccccaatctagactctaataaacagaaatgatttttgttgcaagctgaaaactcgttcttgtggttggggctaggggggtggcaagtcaagctttagagttgtctggataataaatgctgtcttcaaggactgtccaacattgtaggaacaagagaacaacccaagtgaacaactaactcctgttcacaaatgctactgcctctctgccatcccctaacctcagcctcacacacttgaatttcgccaatccatttgatgagctcaaatcagtgaattttctcctcgccaaagctcacaaattctgttccccgcttcttgccccacatccaggcattaccaactgcattttccctttgcctgatattctggcatcaagcctccttgccattccaatttatttcaccttcctccagtccttatgatttccttcctgaagagtatttcagcatctctatgcctcaatcttccctgcacaccacaccagctcggcctcatcatcacattacttggctatgtcccgcctgggttagacagcttcagtggctgaagtccatagatcttattctgtttttcgaggtccacctgactctgaatccagctgacatttctgcccttagcttctacccctctctacttctggttaactatggaccacactctgcttcctcaggaaccacctaccaaggccgtatccatccttcaaggacaatacgtgggcctttcctgatcacatcagctcaacaacttttccctcctacatttcaattgctcttcttaccataatcattagtattcaccccactgtacgtctagaaagaaagtggtcttaaacctaagggaaggcagtctaggtcagaaatttgttgtccgctgttctgagcagtttcttctaggaagtaccaaacatttctgataatagaattgagcaatttcctgatgaagtgagactcagcttgcactgttgaccggctgtcctggatgaacctagttacttttaaccaaatgttcctttcttgaacttgttcctttcttgaacttaatctatcaatgttatctagataactttcctcaaaaaaaaaaaaaaaaaaaaaaaccctctactaggaaagaaatctttgaaccggacttattggaaattacctccttgcagcaggtttgaaacaaaactttgaatttgcctcacaaagaatttgtctgaaactgctttagtatatgctagttatatttgtatgcacatgtggcttcatacatagtggttggacacccatatgtgttatgcactttgttaggtgacgtaagttcacagataaactggaacatagggctatcctctagaggcccacagtttgacaccttaacctgagatccttggacctttgaagttcagagtgcccacaaccgctgggtgtggtggctcacacttgtaatcccagtactctgcagggctgaggtgggaggatcgcttgagtccaggagtctgagaccagcctgggcaacatgacaaaaccccatctctacaaaaattacaaaaaaaattagccaggcctggtggtgcatgcctgtggtcccagttacttgagaggctgaagtgggaggatcacttgagtcaaggaggtagaggctgcagtgagttgagatggcaacactgcactccagaaaccccatctcaaacaaaacagagcaaaacaaaacaaactgcccataatgctcctgaaacttcctacggatttatccagagtatgtgctgatgtgcattttttccaaggagggaaaccaaaggttctatcaaattaagaaaagagtttttaccattgtggaagacagtatggcgattcctcaagcatctaaaatcagaaataccatttgacccagcaatcctattactgggtatatacccaaaggaatagaaatcattctactataaagtcacatgcaaccgtatgtttattgcagcactatttacaatagcaaaatggaaccaactgaaatgcccatcaatgagactagataaagaaaatgtgatacatatacaccatggaatactatgcagccatgaaaaggaatgagatcacgtccttggcagggacatggatgaagctggaagccattatcctcagcaaactaacacaggaacagaaaaccaaatgccgcatgttctcactcataagtgggagttgaacaatgacagcacatagacatagggaggggaacatcacacgccagggcctgctgcagggtggggggtggggtgtgaggggagggaacttagaagacaggtgagtaggtgcagcagaccaccatggcacacttatacctatgtaaccaacctgcacgttctacacatgtatcctggaacttaaattaaaaacaaaaaagagtttttaatccaagaaagattaacagcaactagaagaaagaaagagatataaacagtgaattgcaatgcagcacggcaggtgttatgatggagtagaaaggactggaaaaggcctcctggaggaagggacactcaagtgtctttccatttcacctgtaaactcattaagggcaaaagctttgctacagcttcagtatgagatcctgggcaatccgtgacaaaatgggtctgcttttgcacccccaacttcttctcacatccctgcatcgtgccatgcagcatcaactggaaacctcagcgtcagcaaacgacgacagagcgttcatccgtaaggtgaaccagaaaagccagttcaatgacttgtttaaccatggtccatctcagaaccaagagttgggcctcttatttaccagaaaaattgtgggggctttgtgatatggctttaaaaaaatcttgtaattgccaggcgtggtggctcacacctgtaatcccagcactttgggaggccgaggtgggtgaatcgcctaaggtcaggagttcgagaccagcctgaccaacatggtgaaactccgtctctactaaaaatacaaaaactagctggatgtggtgacgcgtgcctgtaatcctagctactcaggaggctgacgcaggagaatcacttgaacctgggaggcagaggttgcagtgagccaagattgtgccattgcgctccaaaaaaaaaaaaaaaatacattaacataaatttaaatattttataatgacaatccacattaactacttaaagcataagctattttccaggagaggcagcaagtgcattctactcccatgcccaagaagaaaggagcgtgactttggtgggagtactaggagtttctactggagcacttgcccgcagagtgagaaacgttcctagagaggaagttatacctgctgtggaatttaagagaatcttgtcatattttgacaagttttttgagatggaagtctcactctgtcgcccaggctggagtgcagtggcgcaatctcagctcactgcagcctgcacctcctcggttccagctattctcttgtctcagcctcctgagtaactgggattacaggcgcccgccactacgcctggctaatttttgtatttttagtagaaatggggttttaccatgttggccagactggtctcaaactcccgacctcaggtgatctgcctgcctcagcctcccaaagtgctggaattacaggcgtgtgccactgcgcctggctaatttttttttttttttttttttagtagagacggtggtttcaccatgtcatccaggctggtctcaaactcctgacctcaggtgatccacccaccttggtctaccaaagtgctcggattacaggcatgagccaccaggcccagtcaacgtgatgtgttttggaaccctgaattccttggcttgccggagggttttctttttgttaatatctttgcttgctttctagtatttaaaaaattgtgttttgctctaactatgcaatggctttaagtcttagacaaatttccagggagcaaaacacactcaaccaatttcataataatcagaagagagctctgatcaataaataagcaagactgaattttacaaaataatccaaagtttaaaaccaaagcccactttttgcatgatcctttaagagaaagaaatctggaagcaaaacaccttataaaatgacaatgcactttcaggagcccagggcactgtggtgaaatgatgatggctagtacaggttataagccttggggaattatttatgaattctcaggatccttcagttcgccgcatccttctccattatttgaatattggaggctgcctgaccagaatcttgtcaggactttgctccttcatcccaggtggtcccggctgactcctgaggacgttacagccctgaggggaggactcagcttatgaagtgctgggtgagaccactgccaagaagtgcttgctcaccctaccttcaacggcaggggaatctccctctccttttatgggcgtagctgaagaaaggattcataaatgaagttcaatccttctcatcaaccccagcccacacctccagcaattgaacttgaaaaaaaaaacctggtttgaaaaattaccgcaaactatattgtcatcaaaaaaaaaaaaaaaaaaacacttcctatatttgagatgagagaagagagtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcaggtaagggcctgtgggtgcccccggaattcgaattccccccccccccccccgagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcagggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttctactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttctttgggattgctatgaatgataccctgaatttggcctgcactaatttgatgtttacaggtggacacacaaggtgcaaatcaatgcgtacgtttcctgagaagtgtctaaaaacaccaaaaagggatccgtacattcaatgtttatgcaaggaaggaaagaaagaaggaagtgaagagggagaagggatggaggtcacactggtagaacgtaaccacggaaaagagcgcatcaggcctggcacggtggctcaggcctataaccccagctccctaggagaccaaggcgggagcatctcttgaggccaggagtttgagaccagcctgggcagcatagcaagacacatccctacaaaaaattagaaattggctggatgtggtggcatacgcctgtagtcctagccactcaggaggctgaggcaggaggattgcttgagcccaggagttcgaggctgcagtcagtcatgatggcaccactgcactccagcctgggcaacagagcaagatcctgtctttaaggaaaaaaagacaagggaattcgaattcatggaaatgggaagggcagtgatggagatgggaagggcagtgggggttggaggggtggggattgttgttgggtacgaaaacagaattagatcgaatgaataagatctagtatttgatagcataacagggtgactttagtcaacaataatttattgtacatttaaaaataactaaaagagtatacttggattttaacacaaagaaaggataaatacttgaggtgatggataccccatttaccctgatgtgattattatacattgtatgcctgtatcaaaatagctcatgtgcctcatgaatatagacacctaccacatgcccacaaaattaaaaactaaaaaaaacagtcatctctgaatgctaaacggagtaaggggcttcctggaaggctgggtgaaatgggagtctcggaaagatggtgtgttgcaggctgggaggagggtgagacgctggggtcacctagagggacctgcttgtgtgaagcctacgtattagtgggtatgtgtgtgaccggatggaggcgtcagaggtgttgggtagcctgtgtgagttggcgtgggggtgatgtaggaggggagagagggagggcctgcgttcccttggctcctgtgtgcagctaggcccctatttgacaatgtgtgtctgtgtgtgtgtgtgtgtgtgtgtgtgtgtgtgtgtgccgcccccagcgtaggaggcagatctttatctggccctgggtgcttgaggagtttcaggctttctcataagcctcgtctccccgcctctccaccccaggccttgcccctctatcctctgcacaggaagtgggctggctctgggcttttagtctttgcggccccagcagccagagctcagcagggccctggagagatggccacggtcccagcaccggggaggactggagagcgcgcgctgccaccgccccatgtctcagccaggtgatgtccccctgcctccctcccggcccctgtggaccagccagagggctgggagtgaaagtcacagagaagactttcagctctgactcagttcccccagcagtttctgcctgaactcccatcccccaactttgtcttagaattcgaagagcaagcgccatgttgaagccatcattaccattcacatccctcttattcctgcagctgcccctgctgggagtggggctgaacacgacaattctgacgcccaatgggaatgaagacaccacagctgatttcttcctgaccactatgcccactgactccctcagtgtttccactctgcccctcccagaggttcagtgttttgtgttcaatgtcgagtacatgaattgcacttggaacagcagctctgagccccagcctaccaacctcactctgcattattggtacaagaactcggataatgataaagtccagaagtgcagccactatctattctctgaagaaatcacttctggctgtcagttgcaaaaaaaggagatccacctctaccaaacatttgttgttcagctccaggacccacgggaacccaggagacaggccacacagatgctaaaactgcagaatctggtgatcccctgggctccagagaacctaacacttcacaaactgagtgaatcccagctagaactgaactggaacaacagattcttgaaccactgtttggagcacttggtgcagtaccggactgactgggaccacagctggactgaacaatcagtggattatagacataagttctccttgcctagtgtggatgggcagaaacgctacacgtttcgtgttcggagccgctttaacccactctgtggaagtgctcagcattggagtgaatggagccacccaatccactgggggagcaatacttcaaaagagaatcctttcctgtttgcattggaagccgtggttatctctgttggctccatgggattgattatcagccttctctgtgtgtatttctggctggaacggacgatgccccgaattcccaccctgaagaacctagaggatcttgttactgaataccacgggaacttttcggcctggagtggtgtgtctaagggactggctgagagtctgcagccagactacagtgaacgactctgcctcgtcagtgagattcccccaaaaggaggggcccttggggaggggcctggggcctccccatgcaaccagcatagcccctactgggcccccccatgttacaccctaaagcctgaaacctgaaccccaatcctctgacagaagaaccccagggtcctgtagccctaagtggtactaactttccttcattcaacccacctgcgtctcatactcacctcaccccactgtggctgatttggaattttgtgcccccatgtaagcaccccttcatttggcattccccacttgagaattacccttttgccccgaacatgtttttcttctccctcagtctggcccttccttttcgcaggattcttcctccctccctctttccctcccttcctctttccatctaccctccgattgttcctgaaccgatgagaaataaagtttctgttgataatcatcgagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcagagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtgaagagaagcctcaggcaagccccgaaggccgtcctgagagtgagacttcctgcctcgtcacaacaacagattttcaaatacagacagaaatggctgcaaccatggagacgtccatatttacaacagagyaccaggtagcagtggccggctgtgttttcctgctgatcagcgtcctcctcctgagtgggctcacctggcagcggagacagaggaagagtagaagaacaatctagaaaaccaaaagaacaagaatttcttggtaagaagccgggaacagacaacagaagtcatgaagcccaagtgaaatcaaaggtgctaaatggtcgcccaggagacatccgttgtgcttgcctgcgttttggaagctctgaagtcacatcacaggacacggggcagtggcaaccttgtctctatgccagctcagtcccatcagagagcgagcgctacccacttctaaatagcaatttcgccgttgaagaggaagggcaaaaccactagaactctccatcttattttcatgtatatgtgttcattaaagcatgaatggtatggaactctctccaccctatatgtagtataaagaaaagtaggtttacattcatctcattccaacttcccagttcaggagtcccaaggaaagccccagcactaacgtaaatacacaacacacacactctaccctatacaactggacattgtctgcgtggttcctttctcagccgcttctgactgctgattctcccgttcacgttgcctaataaacatccttcaagaactctgggctgctacccagaaatcattttacccttggctcaatcctctaagctaacccccttccactgagccttcagtcttgaatttctaaaaaacagaggccatggcagaataatctttgggtaacttcaaaacggggcagccaaacccatgaggcaatgtcaggaacagaaggatgaatgaggtcccaggcagagaatcatacttagcaaagttttacctgtgcgttactaattggcctctttaagagttagtttcttgaattctcaggatccttcagttcgccgcatccttctccattatttgaatattggaggctgcctgaccagaatcttgtcaggactttgctccttcatcccaggtggtcccggctgactcctgaggacgttacagccctgaggggaggactcagccttatgaagtgctgggtgagaccactgccaagaagtgcttgctcaccctaccttcaacggcaggggaatctccctctccttttatgggcgtagtgaagaaaggattcataaatgaagttcaatccttctcatcaaccccagcccacacctccagcaattgaacttgaaaaaaaaaacctggtttgaaaaattaccgcaaactatattgtcatcaaaaaaaaaaaaaaaaaaacacttcctatatttgagatgagagaagagagtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcaggtaagggcctgtgggtgcccccggaattcgagctctgtgacgatgacccgccagagatcccacacgccacattcaaagccatggcctacaaggaaggaaccatgttgaactgtgaatgcaagagaggtttccgcagaataaaaagcgggtcactctatatgctctgtacaggaaactctagccactcgtcctgggacaaccaatgtcaatgcacaagctctgccactcggaacacaacgaaacaagtgacacctcaacctgaagaacagaaagaaaggaaaaccacagaaatgcaaagtccaatgcagccagtggaccaagcgagccttccaggtcactgcaaggaacctccaccatgggaaaatgaagccacagagagaatttatcatttcgtggtggggcagatggtttattatcagtgcgtccagggatacagggctctacacagaggtcctgctgagagcgtctgcaaaatgacccacgggaagacaaggtggacccagccccagctcatatgcacaggtgaaatggagaccagtcagtttccaggtgaagagaagcctcaggcaagccccgaaggccgtcctgagagtgagacttcctgcctcgtcacaacaacagattttcaaatacagacagaaatggctgcaaccatggagacgtccatatttacaacagagtaccaggtagcagtggccggctgtgttttcctgctgatcagcgtcctcctcctgagtgggctcacctggcagcagagacagaggaagagtagaagaacaatctaggaattctcaggatccttcagttcgccgcatccttctccattatttgaatattggaggctgcctgaccagaatcttgtcaggactttgctccttcatcccaggtggtcccggctgactcctgaggacgttacagccctgagggaggactcagcttatgaagtgctgggtgagaccactgccaagaagtgcttgctcacctaccttcaacggcaggggaatctccctctccttttatgggcgtagctgaagaaaggattcataaatgaagttcaatccttctcatcaccccagcccaacctccagcaattgaacttgaaaaaaaaaacctggtttgaaaaattaccgcaaactatattgtcatcaaaaaaaaaaaaaaaaaaaaacacttcctatatttgagatgagagaagagagtgctaggcagtttcctggctgaacacgccagcccaatacttaaagagagcaactcctgactccgatagagactggatggacccacaagggtgacagcccaggcggaccgatcttcccatcccacatcctccggcgcgatgccaaaaagaggctgacggcaactgggccttctgcagagaaagacctccgcttcactgccccggctggtcccaagggtcaggaagatggattcatacctgctgatgtggggactgctcacgttcatcatggtgcctggctgccaggcaggtaagggcc

SEQ ID NO: 2926 - DNA, 544 bp; single-stranded, linear
aagcttaatataaacaagtttcttgtcactgccaccaccacgaccaaaaaaagctaatcaatcactatatataatacatatatatactatatataataaatatatatactatatataatacatatatacactatatataatacatatatactatatatacactatatactatatatacacatatatattatgaatgtatatatatagtatatatagtatatatactatgtatgtatatatagtatatatagtatatatactatgtatgatatatagtatatatagtatatatactatgtatgtgtatatatagtatatatagtatatatagtatatatactatgtatgtatatatatagtatatatagtatatatactgtgtatgtatatatatagtatatatatactatatatgcatacatagtatatatgcatatatactatatatactatatatttatatatactatatactatatatactatatactgtatatatactatatatgtatgtatacgatatatatatatactatatatgtac

SEQ ID NO: 2927 - DNA, 1102 bp; single-stranded, linear
cagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtgatatttatattttaagaagtaccacttgaaacattttatgtattagttttgaaataataatggaaagtggctatgcagtttgaatatcctttgtttcagagccagatcatttcttggaaagtgtacgcttacctcaaataaatggctaacttatacatatttttaaagaaatatttatattgtatttatataatgtataaaatggtttttataccaataaatggcattttaaaaaattcagca

SEQ ID NO: 2928 - DNA, 1113 bp; single-stranded, linear
gaattccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattc

SEQ ID NO: 2929 - DNA, 2759 bp; single-stranded, linear
aagcttaatataaacaagtttcttgtcactgccaccaccacgaccaaaaaaagctaatcaatcactatatataatacatatatatactatatataataaatatatatactatatataatacatatatacactatatataatacatatatactatatatacactatatactatatatacacatatatattatgaatgtatatatatagtatatatagtatatatactatgtatgtatatatagtatatatagtatatatactatgtatgatatatagtatatatagtatatatactatgtatgtgtatatatagtatatatagtatatatagtatatatactatgtatgtatatatatagtatatatagtatatatactgtgtatgtatatatatagtatatatatactatatatgcatacatagtatatatgcatatatactatatatactatatatttatatatactatatactatatatactatatactgtatatatactatatatgtatgtatacgatatatatatatactatatatgtaccagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtgatatttatattttaagaagtaccacttgaaacattttatgtattagttttgaaataataatggaaagtggctatgcagtttgaatatcctttgtttcagagccagatcatttcttggaaagtgtacgcttacctcaaataaatggctaacttatacatatttttaaagaaatatttatattgtatttatataatgtataaaatggtttttataccaataaatggcattttaaaaaattcagcagaattccgggaacgaaagagaagctctatctcccctccaggagcccagctatgaactccttctccacaagcgccttcggtccagttgccttctccctggggctgctcctggtgttgcctgctgccttccctgccccagtacccccaggagaagattccaaagatgtagccgccccacacagacagccactcacctcttcagaacgaattgacaaacaaattcggtacatcctcgacggcatctcagccctgagaaaggagacatgtaacaagagtaacatgtgtgaaagcagcaaagaggcactggcagaaaacaacctgaaccttccaaagatggctgaaaaagatggatgcttccaatctggattcaatgaggagacttgcctggtgaaaatcatcactggtcttttggagtttgaggtatacctagagtacctccagaacagatttgagagtagtgaggaacaagccagagctgtgcagatgagtacaaaagtcctgatccagttcctgcagaaaaaggcaaagaatctagatgcaataaccacccctgacccaaccacaaatgccagcctgctgacgaagctgcaggcacagaaccagtggctgcaggacatgacaactcatctcattctgcgcagctttaaggagttcctgcagtccagcctgagggctcttcggcaaatgtagcatgggcacctcagattgttgttgttaatgggcattccttcttctggtcagaaacctgtccactgggcacagaacttatgttgttctctatggagaactaaaagtatgagcgttaggacactattttaattatttttaatttattaatatttaaatatgtgaagctgagttaatttatgtaagtcatatttatatttttaagaagtaccacttgaaacattttatgtattagttttgaaataataatggaaagtggctatgcagtttgaatatcctttgtttcagagccagatcatttcttggaaagtgtaggcttacctcaaataaatggctaacttatacatatttttaaagaaatatttatattgtatttatataatgtataaatggtttttataccaataaatggcattttaaaaaattc

SEQ ID NO: 2930 - DNA, 1194 bp; single-stranded, linear
ggatcctcctgcaagagacaccatcctgaggggaagagggcttctgaaccagcttgacccaataagaaattcttgggtgccgacggggacagcagattcagagcctagagccgtgcctgcgtccgtagtttccttctagcttctttttgatttcaaatcaagacttacagggagagggagcgataaacacaaactctgcaagatgccacaaggtcctcctttgacatccccaacaaagaaggtgagtagtaatctccccctttctgccctgaaccaagtggcttcagtaagtttcagggctccaggagacctgggcatgcaggtgccgatgaaacagtggtgaagagactcagtggcagtggcagtggggagagcactcgcagcacaggcaaacctctggcacaagagcaaagtcctcactggaggattcccaagggtcacttgggagagggcaggcagcagccaacctcctctaagtgggctgaagcaggtgaagaaatggcagaagacgcggtggtggcaaaaaggagtcacacactccacctggagacgccttgaagtaactgcacgaaatttgagggtggccaggcagttctacaacagccgcctcacagggagagccagaacacagcaagaactcagatgactggtagtattaccttcttcataatcccaggcttggggggctgcgatggagtcagaggaaactcagttcagaacatctttggtttttacaatacaaattaactggaacgctaaattctagcctgttaatctggtcactgaaaaaaaaaaaattttttttttttcaaaaaacatagctttagcttattttttttttctctttgtaaaacttcgtgcatgacttcagctttactcttgtcaagacatgccaagtgctgagtcactaataaagaaaaaagaagtaaaggaagagtggttctgcttcttagcgctagcctcaatgacgacctaagctgcacttttccccctagttgtgtcttgcgatgctaaaggacgtcattgcacaatcttaataaggtttccaatcagccccacccgctctggccccaccctcaccctccaacaaagatttatcaaatgtgggattttcccatgagtctcaatattagagtctcaacccccaataaatataggactggagatgtctctgaggctcattctgccctcgag

SEQ ID NO: 2931 - DNA, 3319 bp; single-stranded, linear
ggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcaagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgacaaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggttagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgcccttagcaaattctgtttttctaggcctggggacggcttttacttaaacgccaaggcctgggggaagaagctctctcctccctttcttccctacagttcaaaaacagctgagggtgagtgggtgaataatacagtatgtcagggcctggtcgttttcaacagaattataattagttcctcattagcagttttgcctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgcgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggaggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctggggtgacagagcaagtgagaccctgtctc

SEQ ID NO: 2932 - DNA, 4513 bp; single-stranded, linear
ggatcctcctgcaagagacaccatcctgaggggaagagggcttctgaaccagcttgacccaataagaaattcttgggtgccgacggggacagcagattcagagcctagagccgtgcctgcgtccgtagtttccttctagcttctttttgatttcaaatcaagacttacagggagagggagcgataaacacaaactctgcaagatgccacaaggtcctcctttgacatccccaacaaagaaggtgagtagtaatctccccctttctgccctgaaccaagtggcttcagtaagtttcagggctccaggagacctgggcatgcaggtgccgatgaaacagtggtgaagagactcagtggcagtggcagtggggagagcactcgcagcacaggcaaacctctggcacaagagcaaagtcctcactggaggattcccaagggtcacttgggagagggcaggcagcagccaacctcctctaagtgggctgaagcaggtgaagaaatggcagaagacgcggtggtggcaaaaaggagtcacacactccacctggagacgccttgaagtaactgcacgaaatttgagggtggccaggcagttctacaacagccgcctcacagggagagccagaacacagcaagaactcagatgactggtagtattaccttcttcataatcccaggcttggggggctgcgatggagtcagaggaaactcagttcagaacatctttggtttttacaatacaaattaactggaacgctaaattctagcctgttaatctggtcactgaaaaaaaaaaaattttttttttttcaaaaaacatagctttagcttattttttttttctctttgtaaaacttcgtgcatgacttcagctttactcttgtcaagacatgccaagtgctgagtcactaataaagaaaaaagaagtaaaggaagagtggttctgcttcttagcgctagcctcaatgacgacctaagctgcacttttccccctagttgtgtcttgcgatgctaaaggacgtcattgcacaatcttaataaggtttccaatcagccccacccgctctggccccaccctcaccctccaacaaagatttatcaaatgtgggattttcccatgagtctcaatattagagtctcaacccccaataaatataggactggagatgtctctgaggctcattctgccctcgagggcggtcccctgttctccccgctcaggtgcggcgctgtggcaggaagccaccccctcggtcggccggtgcgcggggctgttgcgccatccgctccggctttcgtaaccgcaccctgggacggcccagagacgctccagcgcgagttcctcaaatgttttcctgcgttgccaggaccgtccgccgctctgagtcatgtgcgagtgggaagtcgcactgacactgagccgggccagagggagaggagccgagcgcggcgcggggccgagggactcgcagtgtgtgtagagagccgggctcctgcggatgggggctgcccccggggcctgagcccgcctgcccgcccaccgccccgccccgcccctgccacccctgccgcccggttcccattagcctgtccgcctctgcgggaccatggagtggtagccgaggaggaagcatgctggccgtcggctgcgcgctgctggctgccctgctggccgcgccgggagcggcgctggccccaaggcgctgccctgcgcaggaggtggcaagaggcgtgctgaccagtctgccaggagacagcgtgactctgacctgcccgggggtagagccggaagacaatgccactgttcactgggtgctcaggaagccggctgcaggctcccaccccagcagatgggctggcatgggaaggaggctgctgctgaggtcggtgcagctccacgactctggaaactattcatgctaccgggccggccgcccagctgggactgtgcacttgctggtggatgttccccccgaggagccccagctctcctgcttccggaagagccccctcagcaatgttgtttgtgagtggggtcctcggagcaccccatccctgacgacaaaggctgtgctcttggtgaggaagtttcagaacagtccggccgaagacttccaggagccgtgccagtattcccaggagtcccagaagttctcctgccagttagcagtcccggagggagacagctctttctacatagtgtccatgtgcgtcgccagtagtgtcgggagcaagttcagcaaaactcaaacctttcagggttgtggaatcttgcagcctgatccgcctgccaacatcacagtcactgccgtggccagaaacccccgctggctcagtgtcacctggcaagacccccactcctggaactcatctttctacagactacggtttgagctcagatatcgggctgaacggtcaaagacattcacaacatggatggtcaaggacctccagcatcactgtgtcatccacgacgcctggagcggcctgaggcacgtggtgcagcttcgtgcccaggaggagttcgggcaaggcgagtggagcgagtggagcccggaggccatgggcacgccttggacagaatccaggagtcctccagctgagaacgaggtgtccacccccatgcaggcacttactactaataaagacgatgataatattctcttcagagattctgcaaatgcgacaagcctcccagtgcaagattcttcttcagtaccactgcccacattcctggttgctggagggagcctggccttcggaacgctcctctgcattgccattgttctgaggttcaagaagacgtggaagctgcgggctctgaaggaaggcaagacaagcatgcatccgccgtactctttggggcagctggtcccggagaggcctcgacccaccccagtgcttgttcctctcatctccccaccggtgtcccccagcagcctggggtctgacaatacctcgagccacaaccgaccagatgccagggacccacggagcccttatgacatcagcaatacagactacttcttccccagatagctggctgggtggcaccagcagcctggaccctgtggatgacaaaacacaaacgggctcagcaaaagatgcttctcactgccatgccagcttatctcaggggtgtgcggcctttggcttcacggaagagccttgcggaaggttctacgccaggggaaaatcagcctgctccagctgttcagctggttgaggtttcaaacctccctttccaaatgcccagcttaaaggggttagagtgaacttgggccactgtgaagagaaccatatcaagactctttggacactcacacggacactcaaaagctgggcaggttggtgggggcctcggtgtggagaagcggctggcagcccacccctcaacacctctgcacaagctgcaccctcaggcaggtgggatggatttccagccaaagcctcctccagccgccatgctcctggcccactgcatcgtttcatcttccaactcaaactcttaaaacccaagtgcccttagcaaattctgtttttctaggcctggggacggcttttacttaaacgccaaggcctgggggaagaagctctctcctccctttcttccctacagttcaaaaacagctgagggtgagtgggtgaataatacagtatgtcagggcctggtcgttttcaacagaattataattagttcctcattagcagttttgcctaaatgtgaatgatgatcctaggcatttgctgaatacagaggcaactgcattggctttgggttgcaggacctcaggtgagaagcagaggaaggagaggagaggggcacagggtctctaccatcccctgtagagtgggagctgagtgggggatcacagcctctgaaaaccaatgttctctcttctccacctcccacaaaggagagctagcagcagggagggcttctgccatttctgagatcaaaacggttttactgcagctttgtttgttgtcagctgaacctgggtaactagggaagataatattaaggaagacaatgtgaaaagaaaaatgagcctggcaagaatgcgtttaaacttggtttttaaaaaactgctgactgttttctcttgagagggtggaatatccaatattcgctgtgtcagcatagaagtaacttacttaggtgtgggggaagcaccataactttgtttagcccaaaaccaagtcaagtgaaaaaggaggaagagaaaaaatattttcctgccaggcatggaggcccacgcacttcgggaggtcgaggcaggaggatcacttgagtccagaagtttgagatcagcctgggcaatgtgataaaaccccatctctacaaaaagcataaaaattagccaagtgtggtagagtgtgcctgaagtcccagatacttggggggctgaggtgggaggatctcttgagcctgggaggtcaaggctgcagtgagccgagattgcaccactgcactccagcctggggtgacagagcaagtgagaccctgtctc

SEQ ID NO: 2933 - DNA, 1533 bp; single-stranded, linear
atacctaggcactaatttagttccatatgtactatgtgtacctgaaaagttgtgtggcaatcaaattttcacaaatagaatcctgttttaaatacactaagaaagtacctactttatcctttaaacaagaggtcagcagactttttctacaaagggtcagatagtaaagattttacaccttttgtacaatacaatctctatctcatctacttagctctgccattgttgcataaaagcagctgtagatgatacacaaatgggtgaggctgtattccaaatgaaacgttatttgcaaaaacaggtggtagattaaatttggtcccaaggcttacttgggaaaaaaaaagatcttttgaaaaagaaaaaataaatgaataatttttttaaaaaattgttccctaggtcatagtttgccagcccctgccctaaacaaataattcttgaatgcctactgtggtgtgtaagatatgagtaaataccagggatacacagagaacaaaagagaaaaactgctattcttgtgaaacttggaagttggaggtaagctatttaaaataaacccacaataaagtacttcacatagtgcagactgtttctttaaatcaaaactcactccaaacaaccaattgattcactttgtaagtttgaatttttgtcttcagattcttttaaagtgggcccttagtcaggagcggtggctcatgcctgtagtcctagcactttgggaggctgaggcaggcagatcacttgaggtcaggagttcgagacaagcctggccaacatggcgaaaccccgtctccactgaaaacacaaaaattaggctggcatagtggcatttgcctgtagtcctagctactcaggaggctgaggcaggagaattgcttgaacctgggaggtgaaaattgcagtgagccgagatcatgctattgtactccagcctgggcaacaaagcaagactcgtctcaaaaaaataaaaattaaaaaaataaagtagcctctagcctaagatagcttgagcctaggtgtgaatctactgccttactctgatgtaagcacagtaagtgtgggggctgcagggaatatccaggaggaacaataatttcagaggctctgtctcttcatgtccttgacctctgcttacagcagcaatacttttactcagacttcctgtttctggaacttgccttcttttttgctgtgtttatacttcccttgtctgtggttagataagtataaagccctagatctaagcttctctgtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggtgagtcatttctaacttttcttatggattttggattatctgtagcatggtttcaggttattcagttccctaagagacctgagtcaggcactgggtttgagtgc

SEQ ID NO: 2934 - DNA, 1658 bp; single-stranded, linear
ctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcattcactgacctgtgcttttgaggacccagatgtcaacaccaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcatctatcgggaaggagccaatgactttgtggtgacatttaatacatcacacttgcaaaagaagtatgtaaaagttttaatgcatgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcgtcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctattt

SEQ ID NO: 2935 - DNA, 3191 bp; single-stranded, linear
atacctaggcactaatttagttccatatgtactatgtgtacctgaaaagttgtgtggcaatcaaattttcacaaatagaatcctgttttaaatacactaagaaagtacctactttatcctttaaacaagaggtcagcagactttttctacaaagggtcagatagtaaagattttacaccttttgtacaatacaatctctatctcatctacttagctctgccattgttgcataaaagcagctgtagatgatacacaaatgggtgaggctgtattccaaatgaaacgttatttgcaaaaacaggtggtagattaaatttggtcccaaggcttacttgggaaaaaaaaagatcttttgaaaaagaaaaaataaatgaataatttttttaaaaaattgttccctaggtcatagtttgccagcccctgccctaaacaaataattcttgaatgcctactgtggtgtgtaagatatgagtaaataccagggatacacagagaacaaaagagaaaaactgctattcttgtgaaacttggaagttggaggtaagctatttaaaataaacccacaataaagtacttcacatagtgcagactgtttctttaaatcaaaactcactccaaacaaccaattgattcactttgtaagtttgaatttttgtcttcagattcttttaaagtgggcccttagtcaggagcggtggctcatgcctgtagtcctagcactttgggaggctgaggcaggcagatcacttgaggtcaggagttcgagacaagcctggccaacatggcgaaaccccgtctccactgaaaacacaaaaattaggctggcatagtggcatttgcctgtagtcctagctactcaggaggctgaggcaggagaattgcttgaacctgggaggtgaaaattgcagtgagccgagatcatgctattgtactccagcctgggcaacaaagcaagactcgtctcaaaaaaataaaaattaaaaaaataaagtagcctctagcctaagatagcttgagcctaggtgtgaatctactgccttactctgatgtaagcacagtaagtgtgggggctgcagggaatatccaggaggaacaataatttcagaggctctgtctcttcatgtccttgacctctgcttacagcagcaatacttttactcagacttcctgtttctggaacttgccttcttttttgctgtgtttatacttcccttgtctgtggttagataagtataaagccctagatctaagcttctctgtcttcctccctccctcccttcctcttactctcattcatttcatacacactggctcacacatctactctctctctctatctctctcagaatgacaattctaggtacaacttttggcatggttttttctttacttcaagtcgtttctggagaaagtggctatgctcaaaatggtgagtcatttctaacttttcttatggattttggattatctgtagcatggtttcaggttattcagttccctaagagacctgagtcaggcactgggtttgagtgcctctctctctatctctctcagaatgacaattctaggtacaacttttggcatggttttttctttacttcaagtcgtttctggagaaagtggctatgctcaaaatggagacttggaagatgcagaactggatgactactcattctcatgctatagccagttggaagtgaatggatcgcagcattcactgacctgtgcttttgaggacccagatgtcaacaccaccaatctggaatttgaaatatgtggggccctcgtggaggtaaagtgcctgaatttcaggaaactacaagagatatatttcatcgagacaaagaaattcttactgattggaaagagcaatatatgtgtgaaggttggagaaaagagtctaacctgcaaaaaaatagacctaaccactatagttaaacctgaggctccttttgacctgagtgtcatctatcgggaaggagccaatgactttgtggtgacatttaatacatcacacttgcaaaagaagtatgtaaaagttttaatgcatgatgtagcttaccgccaggaaaaggatgaaaacaaatggacgcatgtgaatttatccagcacaaagctgacactcctgcagagaaagctccaaccggcagcaatgtatgagattaaagttcgatccatccctgatcactattttaaaggcttctggagtgaatggagtccaagttattacttcagaactccagagatcaataatagctcaggggagatggatcctatcttactaaccatcagcattttgagttttttctctgtcgctctgttggtcatcttggcctgtgtgttatggaaaaaaaggattaagcctatcgtatggcccagtctccccgatcataagaagactctggaacatctttgtaagaaaccaagaaaaaatttaaatgtgagtttcaatcctgaaagtttcctggactgccagattcatagggtggatgacattcaagctagagatgaagtggaaggttttctgcaagatacgtttcctcagcaactagaagaatctgagaagcagaggcttggaggggatgtgcagagccccaactgcccatctgaggatgtagtcgtcactccagaaagctttggaagagattcatccctcacatgcctggctgggaatgtcagtgcatgtgacgcccctattctctcctcttccaggtccctagactgcagggagagtggcaagaatgggcctcatgtgtaccaggacctcctgcttagccttgggactacaaacagcacgctgccccctccattttctctccaatctggaatcctgacattgaacccagttgctcagggtcagcccattcttacttccctgggatcaaatcaagaagaagcatatgtcaccatgtccagcttctaccaaaaccagtgaagtgtaagaaacccagactgaacttaccgtgagcgacaaagatgatttaaaagggaagtctagagttcctagtctccctcacagcacagagaagacaaaattagcaaaaccccactacacagtctgcaagattctgaaacattgctttgaccactcttcctgagttcagtggcactcaacatgagtcaagagcatcctgcttctaccatgtggatttggtcacaaggtttaaggtgacccaatgattcagctattt

SEQ ID NO: 2936 - DNA, 1846 bp; single-stranded, linear; identical to SEQ ID NO: 2570

SEQ ID NO: 2937 - DNA, 1041 bp; single-stranded, linear
ctaaagatctccctccaggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctaaataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactt

SEQ ID NO: 2938 - DNA, 2887 bp; single-stranded, linear
ctcagcctcgctatggctcccagcagcccccggcccgcgctgcccgcactcctggtcctgctcggggctctgttcccaggacctggcaatgcccagacatctgtgtccccctcaaaagtcatcctgccccggggaggctccgtgctggtgacatgcagcacctcctgtgaccagcccaagttgttgggcatagagaccccgttgcctaaaaaggagttgctcctgcctgggaacaaccggaaggtgtatgaactgagcaatgtgcaagaagatagccaaccaatgtgctattcaaactgccctgatgggcagtcaacagctaaaaccttcctcaccgtgtactggactccagaacgggtggaactggcacccctcccctcttggcagccagtgggcaagaaccttaccctacgctgccaggtggagggtggggcaccccgggccaacctcaccgtggtgctgctccgtggggagaaggagctgaaacgggagccagctgtgggggagcccgctgaggtcacgaccacggtgctggtgaggagagatcaccatggagccaatttctcgtgccgcactgaactggacctgcggccccaagggctggagctgtttgagaacacctcggccccctaccagctccagacctttgtcctgccagcgactcccccacaacttgtcagcccccgggtcctagaggtggacacgcaggggaccgtggtctgttccctggacgggctgttcccagtctcggaggcccaggtccacctggcactgggggaccagaggttgaaccccacagtcacctatggcaacgactccttctcggccaaggcctcagtcagtgtgaccgcagaggacgagggcacccagcggctgacgtgtgcagtaatactggggaaccagagccaggagacactgcagacagtgaccatctacagctttccggcgcccaacgtgattctgacgaagccagaggtctcagaagggaccgaggtgacagtgaagtgtgaggcccaccctagagccaaggtgacgctgaatggggttccagcccagccactgggcccgagggcccagctcctgctgaaggccaccccagaggacaacgggcgcagcttctcctgctctgcaaccctggaggtggccggccagcttatacacaagaaccagacccgggagcttcgtgtcctgtatggcccccgactggacgagagggattgtccgggaaactggacgtggccagaaaattcccagcagactccaatgtgccaggcttgggggaacccattgcccgagctcaagtgtctaaaggatggcactttcccactgcccatcggggaatcagtgactgtcactcgagatcttgagggcacctacctctgtcgggccaggagcactcaaggggaggtcacccgcgaggtgaccgtgaatgtgctctccccccggtatgagattgtcatcatcactgtggtagcagccgcagtcataatgggcactgcaggcctcagcacgtacctctataaccgccagcggaagatcaagaaatacagactacaacaggcccaaaaagggacccccatgaaaccgaacacacaagccacgcctccctgaacctatcccgggacagggcctcttcctcggccttcccatattggtggcagtggtgccacactgaacagagtggaagacatatgccatgcagctacacctaccggccctgggacgccggaggacagggcattgtcctcagtcagatacaacagcatttggggccatggtacctgcacacctaaaacactaggccacgcatctgatctgtagtcacatgactaagccaagaggaaggctaaagatctccctccaggcagcccttggctggtccctgcgagcccgtggagactgccagagatgtcctctttcggttacaggaccctgactgtggccctcttcaccctgatctgctgtccaggatcggatgagaaggtattcgaggtacacgtgaggccaaagaagctggcggttgagcccaaagggtccctcgaggtcaactgcagcaccacctgtaaccagcctgaagtgggtggtctggagacctctctaaataagattctgctggacgaacaggctcagtggaaacattacttggtctcaaacatctcccatgacacggtcctccaatgccacttcacctgctccgggaagcaggagtcaatgaattccaacgtcagcgtgtaccagcctccaaggcaggtcatcctgacactgcaacccactttggtggctgtgggcaagtccttcaccattgagtgcagggtgcccaccgtggagcccctggacagcctcaccctcttcctgttccgtggcaatgagactctgcactatgagaccttcgggaaggcagcccctgctccgcaggaggccacagccacattcaacagcacggctgacagagaggatggccaccgcaacttctcctgcctggctgtgctggacttgatgtctcgcggtggcaacatctttcacaaacactcagccccgaagatgttggagatctatgagcctgtgtcggacagccagatggtcatcatagtcacggtggtgtcggtgttgctgtccctgttcgtgacatctgtcctgctctgcttcatcttcggccagcacttgcgccagcagcggatgggcacctacggggtgcgagcggcttggaggaggctgccccaggccttccggccatagcaaccatgagtggcatggccaccaccacggtggtcactggaactcagtgtgactcctcagggttgaggtccagccctggctgaaggactgtgacaggcagcagagacttgggacattgccttttctagcccgaatacaaacacctggactt

SEQ ID NO: 2939 - DNA, 1739 bp; single-stranded, linear
aatggccaccatggtaccatccgtgttgtggcccagggcctgctggactctgctggtctgctgtctgctgaccccaggtgtccaggggcaggagttccttttgcgggtggagccccagaaccctgtgctctctgctggagggtccctgtttgtgaactgcagtactgattgtcccagctttgagaaaatcgccttggagacgtccctatcaaaggagctggtggccagtggcatgggctgggcagccttcaatctcagcaacgtgactggcaacagtcggatcctctgctcagtgtactgcaatggctcccagataacaggctcctctaacatcaccgtgtacgggctcccggagcgtgtggagctggcacccctgcctccttggcagccggtgggccagaacttcaccctgcgctgccaagtggagggtgggtcgccccggaccagcctcacggtggtgctgcttcgctgggaggaggagctgagccggcagcccgcagtggaggagccagcggaggtcactgccactgtgctggccagcagagacgaccacggagcccctttctcatgccgcacagaactggacatgcagccccaggggctgggactgttcgtgaacacctcagccccccgccagctccgaacctttgtcctgcccgtgacccccccgcgcctcgtggccccccggttcttggaggtggaaacgtcgtggccggtggactgcaccctagacgggctttttccagcctcagaggcccaggtctacctggcgctgggggaccagatgctgaatgcgacagtcatgaaccacggggacacgctaacggccacagccacagccacggcgcgcgcggatcaggagggtgcccgggagatcgtctgcaacgtgaccctagggggcgagagacgggaggcccgggagaacttgacggtctttagcttcctaggacccattgtgaacctcagcgagcccaccgcccatgaggggtccacagtgaccgtgagttgcatggctggggctcgagtccaggtcacgctggacggagttccggccgcggccccggggcagccagctcaacttcagctaaatgctaccgagagtgacgacggacgcagcttcttctgcagtgccactctcgaggtggacggcgagttcttgcacaggaacagtagcgtccagctgcgagtcctgtatggtcccaaaattgaccgagccacatgcccccagcacttgaaatggaaagataaaacgagacacgtgctgcagtgccaagccaggggcaacccgtaccccgagctgcggtgtttgaaggaaggctccagccgggaggtgccggtggggatcccgttcttcgtcaacgtaacacataatggtacttatcagtgccaagcgtccagctcacgaggcaaatacaccctggtcgtggtgatggacattgaggctgggagctcccactttgtccccgtcttcgtggcggtgttactgaccctgggcgtggtgactatcgtactggccttaatgtacgtcttcagggagcaccaacggagcggcagttaccatgttagggaggagagcacctatctgcccctcacgtctatgcagccgacagaagcaatgggggaagaaccgtccagagctgagtgacgctgggatccgggatcaaagttggcgggggcttggctgtgccctcagattccgcaccaataaagccttcaaaccctaaaaaaaaaaaaaaaaa

SEQ ID NO: 2940 - DNA, 920 bp; single-stranded, linear
gcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgt

SEQ ID NO: 2941 - DNA, 5292 bp; single-stranded, linear
ttgtcagagccccagctggtgtccagggactgaccgtgagcctgggtgaaagtgagttccccgttggaggcaccagacgaggagaggatggaaggcctggcccccaagaatgagccctgaggttcaggagcggctggagtgagccgcccccagatctccgtccagctgcgggtcccagaggcctgggttacactcggagctcctgggggaggcccttgacgtgctcagttcccaaacaggaaccctgggaaggaccagagaagtgcctattgcgcagtgagtgcccgacacagctgcatgtggccggtatcacagggccctgggtaaactgaggcaggcgacacagctgcatgtggccggtatcacagggccctgggtaaactgaggcaggcgacacagctgcatgtggccggtatcacagggccctgggtaaactgaggcaggcgacacagctgcatgtggccggtatcacagggccctgggtaaactgaggcaggcgacacagctgcatgtggccggtatcacggggccctggataaacagaggcaggcgaggccacccccatcaagtccctcaggtctaggtttggccaggtttggaaaaacacagcaacgctcggtaaatctgaatttcgggtaagtatatcctgggcctcatttggaagagacttagattaaaaaaaaaacgtcgagaccagcccggccaacacgtgaaaccccgtctctactaaaaatacaaaaaattagccaggcgcagtgctcacgcctgtgatcccagcactctgggaggtgaggcaggcggatcacccgaggtcagctgttcaagaccagcctggccgagtgggcgaaacactgtctctactacaaatacaaaaattagccgggagtggaggcaggtgcctgtaatctcagctattcaggaggctgaggcaggagaatcacttgaacctgggaggcggaggttgccgtgagccgggatcacgccaccgcactccagcctgggcgatagagcaagactctgtctccaaaaaaataaattaaaaaacccacattgattatctgacatttgaatgcgattgtgcatcctgaattttgtctggaggccccacccgagccaatccagcgtcttgtcccccttctcccccttttcatcaacgcctgtgccaggggagaggaagtggagggcgctggccggccgtggggcaatgcaacggcctcccagcacagggctataagaggagccgggcgggcacggaggggcagagaccccggagccccagccccaccatgaccctcggccgccgactcgcgtgtcttttcctcgcctgtgtcctgccggccttgctgctggggggtgagtttttgagtccaacctcccgctgctccctctgtcccgggttctgttcccacctctccatagagggccccaccagtgtgggtccctcatcctcacaggggaggtgccagctgggacaaggagaccagaagagactgaggttctgagcggtgaagccaccaccaggagcccagagttggggtttgaaaaccggggagggggggggtggcaggtcgccctctgggttcaagtccaggtctgtctgtgccttggaggggcaccgtggggaggtccctttgcctctccgtgcctcagtttcctcatctgaacaacaggggtgcgaacggccccgatcccgtgggttcccggtgggggatccagaggccccgtggccgggaggggacaggctccttggcaggcactcagcacccgcacccggtgtgtccccaggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtgtgagtagccgggagtgtgcgcgcccggctcggaccccgcgtcccggtctgtgaggtgggtggggggaggccggggccggggctgctggcgggggggggtccgtccagggcccgcggggcccctcgagcaccttcgccctcaggcccgtcgccggatggggacgacaaggcgcggctgagccccgacccccggggccgcccctgagccccgcctctccctcttttggcagaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccaggtgccgccgggcgggcgggggcgaggggcggaggccagaggcctggggagggtggaggcctggggagggtggaggctgcgacggaggggcgcgtcggggccgctcgtggggacctggggtggcatcgtgggctgggtggtcccctctccgcgcctcggtctgcacctctgtgaaacgggaaaatacccgccatgggccgttgaggggttaaatgagatcctgcagggaggccccgatctgctgtcaatcaacaaacttactgagaagggaggccccgatctgttgtcaatcaacaaacttactgagaagggaggccccgatctgttgtcaatcaacaaacttactgagaagggaggccccgatctgctgtcaatcaacaaacttactgagaagggaggccccgatgttgtcaatcaacaaacttactgagaagggaggccccgatctgctgtcaatcaaccaaacttactgagaagggaggccccgatctgctgtcaatcatcaaacttactgagaagggaggccccgatctgctgtcaatcaacaaacttactgagaagggaggcccccgatctgttgtcaatcaacaaacttactgagaagggaggccccgatctgctgtcaatcaacaaacttactgagattctgtgtgtctctccattcaccagtcctgtggcccagggcaggggccgcctctgtctttgggaaaaggggcaaaagtccccacctttccacccctgtccgcggcttgcagttctggttatttcctgggcgccgggccccgtggctcaggcctgtcatcccagcactttgggaggctgaggcgggtggatcacgaggtcaggtgttcgagaccagcctgagcaacatagtgaaaccccgtctctactaaaatacacaaaaaaaaaattagccgagtgtggttgtgggtgcctgtaatgccaactactcaggaggctgaggaaggagaatcgcttgaaccccggaggcggagattgcagtgagctgagatcacaccactgcactccagcctgggtctcaaaaaaaaaaaaaaagattcctccctgggaagggttagagggagagtttccttgtcactaagttttctcatagctctcacccagtgcagtggcgcgatcgcagctcactacacctccatctcctgggctcaagccaccctctcagcttggaatggggggtagctggaaccacaggtgccaccacgtggtccaccacgtctggctaatatatatatatacacacacacatacatatattataaataataaatatatattttatttaaataaaatatataatatttataattattttataattataataatatttatataattataaatatcatttataattataatatttattattttataaaataataaatataaaatatataaaaatatttttataaataataaaatatatatatacacacatatatatatattttttgagacaagtctcgctctgtcgcccaggctggagcgcagtgcacaatctcactcactgcacctccgcctcccaggttcaagcgattctcctgcctcagcctcccaggtagctgggactacaggcgcccgccaccacgcctggctaatttttggtattgttagtagagacggggtttaaccatgttagccaggatggtcttgatctcctgaccttttgattggcccacctcagcctcccaaaatgctgggattataggcgtgagcaccgcacctggcaatttttttttattatttttgtagacatggggctttgccacattgcccaggctggtcttgaatgcctggcctggcctaagtgatcctcctgcctcgccctcccaaagtgctgggcttacaagcatgagccaccgcgcccggctgtagtttttttgttaactgagcacctactgcttcctgcactcaagccacatccagggacaacctccaacgccctgagccttggtgacggctcccactctacagatggggaaaccgaggcttgccttggggagcagagtgtggggtgggtatcctgccctgcaggatcccagaaccacagtggaacctgagatggggaaactgaggcccggagaggggagggtcatcatcactgccccgtgtgacgcgctgacgatctgtccccaccgccacagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcgtacgtgccctgggtgtccctctgctccccacccgctcccagcccggtactgcagcaacaggcaccgtggctagaccctaggatgggacttcccaaccctgacacgtcggcgggcaggtgggcagggcctcgcagtccagcttccccaccttgtctgcctccacagggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtagaatgtgtttgatgctccttggctgtgtgattgggtgttgaaaatggtcagtaggtcgggcgtggtggctcacacctgtaatcccagcactttgggaggttgaggcaggcggatcacttgagctc

SEQ ID NO: 2942 - DNA, 6212 bp; single-stranded, linear
gcacggaggggcagagaccccggagccccagccccaccatgaccctcggccgccgactcgcgtgtcttttcctcgcctgtgtcctgccggccttgctgctggggggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtttgtcagagccccagctggtgtccagggactgaccgtgagcctgggtgaaagtgagttccccgttggaggcaccagacgaggagaggatggaaggcctggcccccaagaatgagccctgaggttcaggagcggctggagtgagccgcccccagatctccgtccagctgcgggtcccagaggcctgggttacactcggagctcctgggggaggcccttgacgtgctcagttcccaaacaggaaccctgggaaggaccagagaagtgcctattgcgcagtgagtgcccgacacagctgcatgtggccggtatcacagggccctgggtaaactgaggcaggcgacacagctgcatgtggccggtatcacagggccctgggtaaactgaggcaggcgacacagctgcatgtggccggtatcacagggccctgggtaaactgaggcaggcgacacagctgcatgtggccggtatcacagggccctgggtaaactgaggcaggcgacacagctgcatgtggccggtatcacggggccctggataaacagaggcaggcgaggccacccccatcaagtccctcaggtctaggtttggccaggtttggaaaaacacagcaacgctcggtaaatctgaatttcgggtaagtatatcctgggcctcatttggaagagacttagattaaaaaaaaaacgtcgagaccagcccggccaacacgtgaaaccccgtctctactaaaaatacaaaaaattagccaggcgcagtgctcacgcctgtgatcccagcactctgggaggtgaggcaggcggatcacccgaggtcagctgttcaagaccagcctggccgagtgggcgaaacactgtctctactacaaatacaaaaattagccgggagtggaggcaggtgcctgtaatctcagctattcaggaggctgaggcaggagaatcacttgaacctgggaggcggaggttgccgtgagccgggatcacgccaccgcactccagcctgggcgatagagcaagactctgtctccaaaaaaataaattaaaaaacccacattgattatctgacatttgaatgcgattgtgcatcctgaattttgtctggaggccccacccgagccaatccagcgtcttgtcccccttctcccccttttcatcaacgcctgtgccaggggagaggaagtggagggcgctggccggccgtggggcaatgcaacggcctcccagcacagggctataagaggagccgggcgggcacggaggggcagagaccccggagccccagccccaccatgaccctcggccgccgactcgcgtgtcttttcctcgcctgtgtcctgccggccttgctgctggggggtgagtttttgagtccaacctcccgctgctccctctgtcccgggttctgttcccacctctccatagagggccccaccagtgtgggtccctcatcctcacaggggaggtgccagctgggacaaggagaccagaagagactgaggttctgagcggtgaagccaccaccaggagcccagagttggggtttgaaaaccggggagggggggggtggcaggtcgccctctgggttcaagtccaggtctgtctgtgccttggaggggcaccgtggggaggtccctttgcctctccgtgcctcagtttcctcatctgaacaacaggggtgcgaacggccccgatcccgtgggttcccggtgggggatccagaggccccgtggccgggaggggacaggctccttggcaggcactcagcacccgcacccggtgtgtccccaggcaccgcgctggcctcggagattgtggggggccggcgagcgcggccccacgcgtggcccttcatggtgtccctgcagctgcgcggaggccacttctgcggcgccaccctgattgcgcccaacttcgtcatgtcggccgcgcactgcgtggcgaatgtgtgagtagccgggagtgtgcgcgcccggctcggaccccgcgtcccggtctgtgaggtgggtggggggaggccggggccggggctgctggcgggggggggtccgtccagggcccgcggggcccctcgagcaccttcgccctcaggcccgtcgccggatggggacgacaaggcgcggctgagccccgacccccggggccgcccctgagccccgcctctccctcttttggcagaaacgtccgcgcggtgcgggtggtcctgggagcccataacctctcgcggcgggagcccacccggcaggtgttcgccgtgcagcgcatcttcgaaaacggctacgaccccgtaaacttgctcaacgacatcgtgattctccaggtgccgccgggcgggcgggggcgaggggcggaggccagaggcctggggagggtggaggcctggggagggtggaggctgcgacggaggggcgcgtcggggccgctcgtggggacctggggtggcatcgtgggctgggtggtcccctctccgcgcctcggtctgcacctctgtgaaacgggaaaatacccgccatgggccgttgaggggttaaatgagatcctgcagggaggccccgatctgctgtcaatcaacaaacttactgagaagggaggccccgatctgttgtcaatcaacaaacttactgagaagggaggccccgatctgttgtcaatcaacaaacttactgagaagggaggccccgatctgctgtcaatcaacaaacttactgagaagggaggccccgatgttgtcaatcaacaaacttactgagaagggaggccccgatctgctgtcaatcaaccaaacttactgagaagggaggccccgatctgctgtcaatcatcaaacttactgagaagggaggccccgatctgctgtcaatcaacaaacttactgagaagggaggcccccgatctgttgtcaatcaacaaacttactgagaagggaggccccgatctgctgtcaatcaacaaacttactgagattctgtgtgtctctccattcaccagtcctgtggcccagggcaggggccgcctctgtctttgggaaaaggggcaaaagtccccacctttccacccctgtccgcggcttgcagttctggttatttcctgggcgccgggccccgtggctcaggcctgtcatcccagcactttgggaggctgaggcgggtggatcacgaggtcaggtgttcgagaccagcctgagcaacatagtgaaaccccgtctctactaaaatacacaaaaaaaaaattagccgagtgtggttgtgggtgcctgtaatgccaactactcaggaggctgaggaaggagaatcgcttgaaccccggaggcggagattgcagtgagctgagatcacaccactgcactccagcctgggtctcaaaaaaaaaaaaaaagattcctccctgggaagggttagagggagagtttccttgtcactaagttttctcatagctctcacccagtgcagtggcgcgatcgcagctcactacacctccatctcctgggctcaagccaccctctcagcttggaatggggggtagctggaaccacaggtgccaccacgtggtccaccacgtctggctaatatatatatatacacacacacatacatatattataaataataaatatatattttatttaaataaaatatataatatttataattattttataattataataatatttatataattataaatatcatttataattataatatttattattttataaaataataaatataaaatatataaaaatatttttataaataataaaatatatatatacacacatatatatatattttttgagacaagtctcgctctgtcgcccaggctggagcgcagtgcacaatctcactcactgcacctccgcctcccaggttcaagcgattctcctgcctcagcctcccaggtagctgggactacaggcgcccgccaccacgcctggctaatttttggtattgttagtagagacggggtttaaccatgttagccaggatggtcttgatctcctgaccttttgattggcccacctcagcctcccaaaatgctgggattataggcgtgagcaccgcacctggcaatttttttttattatttttgtagacatggggctttgccacattgcccaggctggtcttgaatgcctggcctggcctaagtgatcctcctgcctcgccctcccaaagtgctgggcttacaagcatgagccaccgcgcccggctgtagtttttttgttaactgagcacctactgcttcctgcactcaagccacatccagggacaacctccaacgccctgagccttggtgacggctcccactctacagatggggaaaccgaggcttgccttggggagcagagtgtggggtgggtatcctgccctgcaggatcccagaaccacagtggaacctgagatggggaaactgaggcccggagaggggagggtcatcatcactgccccgtgtgacgcgctgacgatctgtccccaccgccacagctcaacgggtcggccaccatcaacgccaacgtgcaggtggcccagctgccggctcagggacgccgcctgggcaacggggtgcagtgcctggccatgggctggggccttctgggcaggaaccgtgggatcgccagcgtcctgcaggagctcaacgtgacggtggtgacgtccctctgccgtcgcagcaacgtctgcactctcgtgaggggccggcaggccggcgtctgtttcgtacgtgccctgggtgtccctctgctccccacccgctcccagcccggtactgcagcaacaggcaccgtggctagaccctaggatgggacttcccaaccctgacacgtcggcgggcaggtgggcagggcctcgcagtccagcttccccaccttgtctgcctccacagggggactccggcagccccttggtctgcaacgggctaatccacggaattgcctccttcgtccggggaggctgcgcctcagggctctaccccgatgcctttgccccggtggcacagtttgtaaactggatcgactctatcatccaacgctccgaggacaacccctgtccccacccccgggacccggacccggccagcaggacccactgagaagggctgcccgggtcacctcagctgcccacacccacactctccagcatctggcacaataaacattctctgttttgtagaatgtgtttgatgctccttggctgtgtgattgggtgttgaaaatggtcagtaggtcgggcgtggtggctcacacctgtaatcccagcactttgggaggttgaggcaggcggatcacttgagctc

SEQ ID NO: 2943 - DNA, 1755 bp; single-stranded, linear; identical to SEQ ID NO: 2595

SEQ ID NO: 2944 - DNA, 600 bp; single-stranded, linear
ctgcagaccggtggcgatggccatcctcccagcagcagaaacctggatagacgggggtggaggcgtgggtgcagacgccgtgaacctgaccgcctcgctagctgccggggcggccacgggggcagttgagactgggtggctgcaactgctggaccaagctggcaacctctcctcctccccttccgcgctgggactgcctgtgcgttcccccgcgccctcccagccctgggccaacctcaccaaccagttcgtgcagccgtcctggcgtatcgcgctctggtccctggcgtatggtgtggtggtggcagtggcagttttgggaaatctcatcgtcatctggatcatcctggcccacaagcgcatgaggactgtcaccaactacttccttgtgaacctggctttctccgacgcctccatggccgccttcaacacgttggtcaatttcatctacgcgcttcatagcgagtggtactttggcgccaactactgccgcttccagaacttctttcctatcacagctgtgttcgccagcatctactccatgacggccattgcggtggacaggtgaggagaggacagacagagaggaaagagggagaa

SEQ ID NO: 2945 - DNA, 227 bp; single-stranded, linear
ggtatatggctattattgatcccttgaaacccagactgtctgctacagcaaccaagattgtcattggaagtatttggattctagcatttctacttgccttccctcagtgtctttattccaaaaccaaagtcatgccaggccgtactctctgctttgtgcaatggccagaaggtcccaaacaacatttcacgtaagttaattctctattatggttttcaattcagttt

SEQ ID NO: 2946 - DNA, 201 bp; single-stranded, linear
catgtgtttttcttatttttcatagttaccatattatcgtcattatactggtgtactgtttcccattgctcatcatgggtattacatacaccattgttggaattactctctggggaggagaaatcccaggagatacctgtgacaagtatcatgagcagctaaaggccaaaagaaaggtactggtccatgttgtttacctag

SEQ ID NO: 2947 - DNA, 255 bp; single-stranded, linear
caaatgactttttctttataggttgtcaaaatgatgattattgttgtcatgacatttgctatctgctggctgccctatcatatttacttcattctcactgcaatctatcaacaactaaatagatggaaatacatccagcaggtctacctggctagcttttggctggcaatgagctcaaccatgtacaatcccatcatctactgctgtctgaataaaaggtaaaaacaaaactacgaaatgcaagttgcttgtcac

SEQ ID NO: 2948 - DNA, 449 bp; single-stranded, linear
aaaataacttttctttctgtggcctgcttttcctcagatttcgagctggcttcaagagagcatttcgctggtgtcctttcatcaaagtttccagctatgatgagctagagctcaagaccaccaggtttcatccaaaccggcaaagcagtatgtacaccgtgaccagaatggagtccatgacagtcgtgtttgaccccaacgatgcagacaccaccaggtccagtcggaagaaaagagcaacgccaagagacccaagtttcaatggctgctctcgcaggaattccaaatctgcctccgccacttcaagtttcataagctcaccctatacctctgtggatgaatattcttaattccatttcctgaggtaaaagattagtgtgagaccatcatggtgccagtctaggaccccattctcctatttatcagtcctgtcctatataccctctaga

SEQ ID NO: 2949 - DNA, 3487 bp; single-stranded, linear
ctgcagaccggtggcgatggccatcctcccagcagcagaaacctggatagacgggggtggaggcgtgggtgcagacgccgtgaacctgaccgcctcgctagctgccggggcggccacgggggcagttgagactgggtggctgcaactgctggaccaagctggcaacctctcctcctccccttccgcgctgggactgcctgtgcgttcccccgcgccctcccagccctgggccaacctcaccaaccagttcgtgcagccgtcctggcgtatcgcgctctggtccctggcgtatggtgtggtggtggcagtggcagttttgggaaatctcatcgtcatctggatcatcctggcccacaagcgcatgaggactgtcaccaactacttccttgtgaacctggctttctccgacgcctccatggccgccttcaacacgttggtcaatttcatctacgcgcttcatagcgagtggtactttggcgccaactactgccgcttccagaacttctttcctatcacagctgtgttcgccagcatctactccatgacggccattgcggtggacaggtgaggagaggacagacagagaggaaagagggagaactattgcagtatctttcagcttccagtcttatctgaagaccccggcaccaaagtgaccaggaggcagagaagaacttcagaggagtctcgtcttgggctgcccgtgggtgagtgggagggtccgggactgcagaccggtggcgatggccactctcccagcagcagaaacctggatagacgggggtggaggcgtgggtgcagacgccgtgaacctgaccgcctcgctagctgccggggcggccacgggggcagttgagactgggtggctgcaactgctggaccaagctggcaacctctcctcctccccttccgcgctgggactgcctgtggcttcccccgcgccctcccagccctgggccaacctcaccaaccagttcgtgcagccgtcctggcgcatcgcgctctggtccctggcgtatggtgtggtggtggcagtggcagttttgggaaatctcatcgtcatctggatcatcctggcccacaagcgcatgaggactgtcaccaactacttccttgtgaacctggctttctccgacgcctccatggccgccttcaacacgttggtcaatttcatctacgcgcttcatagcgagtggtactttggcgccaactactgccgcttccagaacttctttcctatcacagctgtgttcgccagcatctactccatgacggccattgcggtggacaggtatatggctattattgatcccttgaaacccagactgtctgctacagcaaccaagattgtcattggaagtatttggattctagcatttctacttgccttccctcagtgtctttattccaaaaccaaagtcatgccaggccgtactctctgctttgtgcaatggccagaaggtcccaaacaacatttcacttaccatattatcgtcattatactggtgtactgtttcccattgctcatcatgggtattacatacaccattgttggaattactctctggggaggagaaatcccaggagatacctgtgacaagtatcatgagcagctaaaggccaaaagaaaggttgtcaaaatgatgattattgttgtcatgacatttgctatctgctggctgccctatcatatttacttcattctcactgcaatctatcaacaactaaatagatggaaatacatccagcaggtctacctggctagcttttggctggcaatgagctcaaccatgtacaatcccatcatctactgctgtctgaataaaagatttcgagctggcttcaagagagcatttcgctggtgtcctttcatcaaagtttccagctatgatgagctagagctcaagaccaccaggtttcatccaaaccggcaaagcagtatgtacaccgtgaccagaatggagtccatgacagtcgtgtttgaccccaacgatgcagacaccaccaggtccagtcggaagaaaagagcaacgccaagagacccaagtttcaatggctgctctcgcaggaattccaaatctgcctccgccacttcaagtttcataagctcaccctatacctctgtggatgaatattcttaattccatttcctgaggtaaaagattagtgtgagaccatcatggtgccagtctaggaccccattctcctatttatcagtcctgtcctatataccctctagaaacagaaagcaatttttaggcagctatggtcaaattgagaaaggtagtgtataaatgtgacaaagacactaataacatgttagcctccacccaaaataaaatgggctttaaatttggtatatggctattattgatcccttgaaacccagactgtctgctacagcaaccaagattgtcattggaagtatttggattctagcatttctacttgccttccctcagtgtctttattccaaaaccaaagtcatgccaggccgtactctctgctttgtgcaatggccagaaggtcccaaacaacatttcacgtaagttaattctctattatggttttcaattcagtttcatgtgtttttcttatttttcatagttaccatattatcgtcattatactggtgtactgtttcccattgctcatcatgggtattacatacaccattgttggaattactctctggggaggagaaatcccaggagatacctgtgacaagtatcatgagcagctaaaggccaaaagaaaggtactggtccatgttgtttacctagcaaatgactttttctttataggttgtcaaaatgatgattattgttgtcatgacatttgctatctgctggctgccctatcatatttacttcattctcactgcaatctatcaacaactaaatagatggaaatacatccagcaggtctacctggctagcttttggctggcaatgagctcaaccatgtacaatcccatcatctactgctgtctgaataaaaggtaaaaacaaaactacgaaatgcaagttgcttgtcacaaaataacttttctttctgtggcctgcttttcctcagatttcgagctggcttcaagagagcatttcgctggtgtcctttcatcaaagtttccagctatgatgagctagagctcaagaccaccaggtttcatccaaaccggcaaagcagtatgtacaccgtgaccagaatggagtccatgacagtcgtgtttgaccccaacgatgcagacaccaccaggtccagtcggaagaaaagagcaacgccaagagacccaagtttcaatggctgctctcgcaggaattccaaatctgcctccgccacttcaagtttcataagctcaccctatacctctgtggatgaatattcttaattccatttcctgaggtaaaagattagtgtgagaccatcatggtgccagtctaggaccccattctcctatttatcagtcctgtcctatataccctctaga

SEQ ID NO: 2950 - DNA, 2206 bp; single-stranded, linear
ctagtctttcagccttcaggctgtttttggcttgaagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaagctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagttgcggatccaccctcagcagcagccccaggaggaaagctctccgcagtccgacatcccagctcctcctagttccaaagcccctggaaaaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctatcatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttc

SEQ ID NO: 2951 - DNA, 2206 bp; single-stranded, linear; identical to SEQ ID NO: 2950

SEQ ID NO: 2952 - DNA, 273 bp; single-stranded, linear
gcagagctgggcaccacagggagctaggctctgtgagccgtggctcatctcacacctcctcactgccttgcatcatggccatgtctggacccttctctcctcaggcctttaccagaagcattaaccgagacaagcacttggcagtggcttacttccaacgagggatgctctactaccagacagagaagtaagtggttcaatgttgcaccaactggaggatttcagagagaaacccaaggggtctcagtgttgcgggcttggtgtttgagcagt

SEQ ID NO: 2953 - DNA, 420 bp; single-stranded, linear
ggtcagaaggaactgaaaggcttcttgtcccagtgagatagctggggaagggagaagcagactcacattttatgctgcatttatttctccatccactagactgctgattttctccctctgtcctggagatatgatttggctatcaaagaccttaaagaagccttgattcagcttcgagggaaccagctgatagactataagatcctggggctccagttcaagctgtttgcctgtgaggtaaggagaacagggcctggctgggcaggaggggatcatggctggatggatggctgacagtcagatgcacagtgatctgttgacacctccaggagcttggaaaagccatttctcctctgccttgagactcagattttccttgaagaaaagactgagatggattatttcaggctcatcaaggca

SEQ ID NO: 2954 - DNA, 780 bp; single-stranded, linear
ttccctggcaccttgatttggagtagtctcaagttttatgtttgcggtctgtacttttctaggtgttatataacattgctttcatgtatgccaagaaggaggaatggaaaaaagctgaagaacagttagcattggccacgagcatgaagtctgagcccagacattccaaaatcgacaaggcgatggagtgtgtctgggtaagcgtattggtgatgcaggtgttgagaggatgtcactggattctcatttgtctcagaggacatgccattgagaagccataaaagtggtgcttttactttctgtgagtctgggtaacactgatcttagggtatagttccacttaagatcttgaatctgtgctgagaagctgaggcctagagtatgggatggcagagcctggcatcacaccacccttggagtggggctccttggcaatgcaggagaacaggatattggatgctggagcagtgctgcacagactctaagcactgagagggcagagtccatgtctgcttgatcaccactgagtcctcacagcctggcacagtgctaggccacataacagctctcagcaaaaatgttttgttttgttttgagatggagtctcgctctgttgcccagcctggagtgcagtggtgtgatctcagctcactgcagcctctgcctcctgggttcaagcaattctgctgcctcagccgcccaagtagctgggattacaggtgcatgccaccatgcctggctaatttttgtatttttaatagagacggggttttgccatgt

SEQ ID NO: 2955 - DNA, 278 bp; single-stranded, linear
gaattcttgcatctattcactgagggaggcaggacaagcatcgtcacccccattttcacataagggaatgctacgttttctgtgttacagaagcagaagctatatgagccagtggtgatccctgtgggcaagctgtttcgaccaaatgagagacaagtggctcagctggccaagaaggattacctaggcaaggcgacggtaggtgggattgctcagcttcccctgagtcttcctgtggcccgggcatgtggagcaaggtgggagggactcttgagaag

SEQ ID NO: 2956 - DNA, 705 bp; single-stranded, linear
gcaggagaatcacttgaacctggaaggcagaggttgcagtgagctgagtcactccactgcactccagtctgggtaacagagcgtgctccgtctcaaaaaaaaaaaaaaaaaaaaagataatttgatgttatacaaattgcacctcaattaaaaacatttcttttttaagagagaagaaagcaagcctgtgttagcaggggtggggtgaatgctcgtttcttcagttgctgaaatcctaatccagaggctcaggaatctaatccttagttactgtccacgtctgaaaccaggctcacgtaagaacaggtctagggcatgagcaaagagggagacccagaagaatggaaacagtgctggcagagcctcacaccctcctgtccttgattttaggtcgtggcatctgtggtggatcaagacagtttctctgggtttgcccctctgcaaccacaggtaaggcagtcctgaccttctccatggacctaggtctcgagagctttctgtgaagcattcaattcgagagactatgtgtgctgagttgcctgattgtaagggctccttcaagtggccctcagtgcagctgaggattctgcctgccctctctcagtcctggtttccatggctggtgaggaaataaggcagtgtcaggcttcaccccaagtcctctgaagctaactctcctgcttccccacaaatgccggtcttcac

SEQ ID NO: 2957 - DNA, 709 bp; single-stranded, linear
actgaattgctgtgctagtgaaacctgtacctgggagctggtgggaggtgttatttcccagtgtttagtcagggtgactgtgccctcttcctagacagtgttctcatcagtcagaaatgcgttatttgattttctggtctggaagaatgctcaaattaccattagccgtttgttgtctctcccctgctttccctcattgccttttccgttttcacttctcctgaatgttcaataggcagctgagcctccacccagaccgaaaaccccagagatcttcaggtaagttagattcaaatccataaatagaatatcaagcgccaagcctgagctgatggcaagaaagggagggaagaagatgaaggtggggtcagggtctaaatcttgttgaattttctggaatgtcaggcttcttctagaatgtcaggctagaaaggaatgcctagaagaatgtcttctagaatgtcaggctagaaaggaatgatatatggggatgggagtcttgactgtggtggggctggccatcagggcttggctgcagctacgtggtccattggccctctgtccacgtgcacagccaccacatgcaggggttgtgctgagggcagtgtgtcctgtggaacatagctacctgggaccagatgctgacctcaggttggagatcggtttcgcactggctgcagtcctctgacggggcaggccagagctctct

SEQ ID NO: 2958 - DNA, 849 bp; single-stranded, linear
tgagcagtgtacaccagtttcttgctgagacctcttggacccaggcaggctcagtgtcatctcggcagttgcagttagatgtggagttagagccaggctgagccaagtccctggctccaagttcagtgtatttgcgccatggcatcatgtgaggggatgggggctggatcttgtgtctatcctctgcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcaggtatgcagaggatcaggggctggtgcgatgggcatgggatcctggcagcaaatgcagtctctgtggagcagtatctgctgccttctttgcagaccagccaagttcttttgtctgttcgtcatcccttccccaggactctgggctgttctgtggtgtgggtactgatgagcacatctttattttttcctttctgattctgtggtgctgcactgcagaaggggcttgttccctgcaactaccttgaaccagttgagctgcggatccaccctcagcagcagccccaggtaatgtgatgccaaggcctgacccatttcctctcaccctttaggatctctccctggagggagaaaagcagtgtaaaagaggtgttgtcaggacccctggagaaagattcactagtcttgagcccgccttgagatggcaccagctacccagagctgaacctgggaatgaggggaaaaaagcccagatgtgctaagttggaggcatctgtaggtcccattggcccacccacctct

SEQ ID NO: 2959 - DNA, 308 bp; single-stranded, linear
aatgtcactaccattccaacttttaggacgttatctgcatgtggctcctttacatggggtctctgtaggggtgtttccccacatccacccctgcctgggaactttgaatgaaggttctgaccatcgctccctgttgccttcaggaggaaagctctccgcagtccgacatcccagctcctcctagttccaaagcccctggaagaccccagctgtcaccaggtgagtggtcctggagccacagcctaggtttgggtgcagcagcatgccaggtgttcctgagttcctctccctgccttccaggaaattct

SEQ ID NO: 2960 - DNA, 463 bp; single-stranded, linear
gactgagtttgttcatgtgttcatgaccttcatgcttccccagggcgagatttccccacagtttactaaggttaataattgccccacaaattaaagggtaagaggttgggggccctatttgaagaggtttcatctgtgtgtggcaggggctggccaaggatgttcattcaccatcttcttttgttttactccctactttttccattcaggccagaaacaaaaagaagagcctaaggtaacatttttccctcatactgtttcaagtggtagaagatgggatagcttgggctatcaaccacagacatgtctgtctggattataggaagagcccaaaggagggtcgaaccagttgctaccttacagagtccatgagctagggaccttcttaatagcctcctccactatcatgcacacacttcctactacccaagctagtgggccagatcttactcagtaggaattc

SEQ ID NO: 2961 - DNA, 784 bp; single-stranded, linear
gaattcctgtccaagcaagggttgggctaaaggacctctgaaggccttttaggctactgtgaaaccagttacttactggcctctcccctgctgtattgggtaccccctgtgccaaatcacgaaactgcggtgatccaggatgttgagagaaagcctcagacactcaggagttccctttgtttcctccccactcaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgaggtgagctccatgcaggcagctgtgaggggtacagtgggaaccttgtgctggcctggaggagggaagaggaggatggtttttgtgatgatgttctttgactggattcttactcattatccccacccagctatcggcctcgggacagcaatgagctggtgcccctttcagaagacagcatgaaggatgcctggggccaggtgaaaaactactgcctgactctgtggtgtgagaacacagtggtgagtgcaatgaggggcatctaaagttacatttccactgagccacttcctcaacaatttgaaatttatcaagcaccttctgtgtactaggcactatatgtggtgttggggatatggtgtgtaataagtcacagctctgcctcccttttacctgcatcctcaccccatttgcagcagggagagagtttcccacaagag

SEQ ID NO: 2962 - DNA, 450 bp; single-stranded, linear
ttcataaagagcatataagctctacacaaggcactgatcacaaactttatgagtttatatcccaggttctactttgacatttcgctgtttcctttagtgatgttcagtgttcacttggcaggaaattgggaaaattaacaggccctttattatttcagggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaagggtaagtgctactccaagactatagaaacaaatttacatgttagcagaaacaaggtcaagggcagagagaagaaatatcaataatctacaaacaaaactttagccagtgttttca

SEQ ID NO: 2963 - DNA, 1145 bp; single-stranded, linear
gtcaattcttgaccctcttctctatctggtaactttttgaaaaacataatttatcctctcttcattttgctcattatcatgtttaagacagatcaataagatggttaaaccctgtgttcactctcaaaccactttgcaatactgtcttttccctgttgatcacaattaggggtggggaagggtgaccgataacaaattctgtgtggaatagccagacagggtaatcttcctacagtggttttagaaatccatgtgtacttttccttttatcagtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttcattatgtcttgttgcttaaacagaacctagactgagttaggttctcatggactacaacactcaattccacagagaattaatagaattacatacctttgtacattctcagagaggaacatgtgttaagaactcaatactgaatatatatcaatcgccaacatttaagtgatgaaaagcagcggtgttcatgaagctagttcgtaa

SEQ ID NO: 2964 - DNA, 75 bp; single-stranded, linear
gtcacatcgccctgctgggctttgagaagcgcttcgtacccagccagcactatgtgtacatgttcctggtgaaat

SEQ ID NO: 2965 - DNA, 7368 bp; single-stranded, linear
ctagtctttcagccttcaggctgtttttggcttgaagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaagctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagttgcggatccaccctcagcagcagccccaggaggaaagctctccgcagtccgacatcccagctcctcctagttccaaagcccctggaaaaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctatcatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttcctagtctttcagccttcaggctgtttttggcttgaagctctcttggcctcctagtttctacctaatcatgtccctggtggaggccatcagcctctggaatgaaggggtgctggcagcggacaagaaggactggaagggagccctggatgccttcagtgccgtccaggacccccactcccggatttgcttcaacattggctgcatgtacactatcctgaagaacatgactgaagcagagaaggcctttaccagaagcattaaccgagacaagcacttggcagtggcttacttccaacgagggatgctctactaccagacagagaaatatgatttggctatcaaagaccttaaagaagccttgattcagcttcgagggaaccagctgatagactataagatcctggggctccagttcaagctgtttgcctgtgaggtgttatataacattgctttcatgtatgccaagaaggaggaatggaaaaaagctgaagaacagttagcattggccacgagcatgaagtctgagcccagacattccaaaatcgacaaggcgatggagtgtgtctggaagcagaagctatatgagccagtggtgatccctgtgggcaagctgtttcgaccaaatgagagacaagtggctcagctggccaagaaggattacctaggcaaggcgacggtcgtggcatctgtggtggatcaagacagtttctctgggtttgcccctctgcaaccacaggcagctgagcctccacccagaccgaaaaccccagagatcttcagggctctggaaggggaggctcaccgtgtgctatttgggtttgtgcctgagacaaaagaagagctccaggtcatgccagggaacattgtctttgtcttgaagaagggcaatgataactgggccacggtcatgttcaacgggcagaaggggcttgttccctgcaactaccttgaaccagttgagttgcggatccaccctcagcagcagccccaggaggaaagctctccgcagtccgacatcccagctcctcctagttccaaagcccctggaaaaccccagctgtcaccaggccagaaacaaaaagaagagcctaaggaagtgaagctcagtgttcccatgccctacacactcaaggtgcactacaagtacacggtagtcatgaagactcagcccgggctcccctacagccaggtccgggacatggtgtctaagaaactggagctccggctggaacacactaagctgagctatcggcctcgggacagcaatgagctggtgcccctttcagaagacagcatgaaggatgcctggggccaggtgaaaaactactgcctgactctgtggtgtgagaacacagtgggtgaccaaggctttccagatgaacccaaggaaagtgaaaaagctgatgctaataaccagacaacagaacctcagcttaagaaaggcagccaagtggaggcactcttcagttatgaggctacccaaccagaggacctggagtttcaggaaggggatataatcctggtgttatcaaaggtgaatgaagaatggctggaaggggagtgcaaagggaaggtgggcattttccccaaagtttttgttgaagactgcgcaactacagatttggaaagcactcggagagaagtctaggatgtttcacaaactacaaagctgaagaaaatgaagccctattacttgtttgtaagatttagcacccttctgctgtatactgtactgagacattacagtttggaagtgttaactatttattccctgttaaaatttaacctactagacaatgatgtgagtacccaggatgatttcctggggcacagtgggtgaggagatggggacaggtgaatggaggagttaggggagaggaaaagtggatggaagtgtctggaaagggcacgagagagtcttccaggtactgatcctgtttcttgctctgagtgctagctagccagctgtgttcacactgtaaacattcatcaagctgtacatttggtgcacttttctgtgtcataccacaataaaaaaaaacctatcatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttcgcagagctgggcaccacagggagctaggctctgtgagccgtggctcatctcacacctcctcactgccttgcatcatggccatgtctggacccttctctcctcaggcctttaccagaagcattaaccgagacaagcacttggcagtggcttacttccaacgagggatgctctactaccagacagagaagtaagtggttcaatgttgcaccaactggaggatttcagagagaaacccaaggggtctcagtgttgcgggcttggtgtttgagcagtggtcagaaggaactgaaaggcttcttgtcccagtgagatagctggggaagggagaagcagactcacattttatgctgcatttatttctccatccactagactgctgattttctccctctgtcctggagatatgatttggctatcaaagaccttaaagaagccttgattcagcttcgagggaaccagctgatagactataagatcctggggctccagttcaagctgtttgcctgtgaggtaaggagaacagggcctggctgggcaggaggggatcatggctggatggatggctgacagtcagatgcacagtgatctgttgacacctccaggagcttggaaaagccatttctcctctgccttgagactcagattttccttgaagaaaagactgagatggattatttcaggctcatcaaggcattccctggcaccttgatttggagtagtctcaagttttatgtttgcggtctgtacttttctaggtgttatataacattgctttcatgtatgccaagaaggaggaatggaaaaaagctgaagaacagttagcattggccacgagcatgaagtctgagcccagacattccaaaatcgacaaggcgatggagtgtgtctgggtaagcgtattggtgatgcaggtgttgagaggatgtcactggattctcatttgtctcagaggacatgccattgagaagccataaaagtggtgcttttactttctgtgagtctgggtaacactgatcttagggtatagttccacttaagatcttgaatctgtgctgagaagctgaggcctagagtatgggatggcagagcctggcatcacaccacccttggagtggggctccttggcaatgcaggagaacaggatattggatgctggagcagtgctgcacagactctaagcactgagagggcagagtccatgtctgcttgatcaccactgagtcctcacagcctggcacagtgctaggccacataacagctctcagcaaaaatgttttgttttgttttgagatggagtctcgctctgttgcccagcctggagtgcagtggtgtgatctcagctcactgcagcctctgcctcctgggttcaagcaattctgctgcctcagccgcccaagtagctgggattacaggtgcatgccaccatgcctggctaatttttgtatttttaatagagacggggttttgccatgtgaattcttgcatctattcactgagggaggcaggacaagcatcgtcacccccattttcacataagggaatgctacgttttctgtgttacagaagcagaagctatatgagccagtggtgatccctgtgggcaagctgtttcgaccaaatgagagacaagtggctcagctggccaagaaggattacctaggcaaggcgacggtaggtgggattgctcagcttcccctgagtcttcctgtggcccgggcatgtggagcaaggtgggagggactcttgagaaggcaggagaatcacttgaacctggaaggcagaggttgcagtgagctgagtcactccactgcactccagtctgggtaacagagcgtgctccgtctcaaaaaaaaaaaaaaaaaaaaagataatttgatgttatacaaattgcacctcaattaaaaacatttcttttttaagagagaagaaagcaagcctgtgttagcaggggtggggtgaatgctcgtttcttcagttgctgaaatcctaatccagaggctcaggaatctaatccttagttactgtccacgtctgaaaccaggctcacgtaagaacaggtctagggcatgagcaaagagggagacccagaagaatggaaacagtgctggcagagcctcacaccctcctgtccttgattttaggtcgtggcatctgtggtggatcaagacagtttctctgggtttgcccctctgcaaccacaggtaaggcagtcctgaccttctccatggacctaggtctcgagagctttctgtgaagcattcaattcgagagactatgtgtgctgagttgcctgattgtaagggctccttcaagtggccctcagtgcagctgaggattctgcctgccctctctcagtcctggtttccatggctggtgaggaaataaggcagtgtcaggcttcaccccaagtcctctgaagctaactctcctgcttccccacaaatgccggtcttcacacattcatcaagctgtacatttggtgcacttttctgtgtcataccacaataaaaaaaaacctatcatcttacaaaaacaagacacccaagtccaggcccaaggagtaagtacaaatattcctgtttctgaaccattactgtaattggctcttaaggcttgaagtaaccttataggttactcataaggcatatacaaataaacttgtttgttttcttttttcattatgtcttgttgcttaaacagaacctagactgagttaggttctcatggactacaacactcaattccacagagaattaatagaattacatacctttgtacattctcagagaggaacatgtgttaagaactcaatactgaatatatatcaatcgccaacatttaagtgatgaaaagcagcggtgttcatgaagctagttcgtaagtcacatcgccctgctgggctttgagaagcgcttcgtacccagccagcactatgtgtacatgttcctggtgaaat

SEQ ID NO: 2966 - DNA, 1064 bp; single-stranded, linear
ccagctgatattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactctaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccttgcttc

SEQ ID NO: 2967 - DNA, 1780 bp; single-stranded, linear
ttcacgagggctggggccaggacccagacagagacacacggtcactgcagctgaagccgctgcccctgctacaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaaacatcatgactgagctgggggaagaagggatatctactgtgggtctgggcaccacctctgtggcactggtgggccattagatttggaggctacctcacctgggcagggatgatgcagagccaggctgttggaaaatccagaactcaaatgagccccttcatccgcctgtgggcgcatactacagtaactgtgactgatgactttatcctgagtcccttaatcttatggggccggaaggaatgtcagggccaggtgcagaccttgggggaagactttaaaccacctagttctcccactggggcatcggtctaaagctttgggggagtggccccagtggctcacacctgtaatcccagcactttgggaggccgaggtgggcagatcatgggtcaagagatcgagacatcctggccaacattgtaaaaccccatctctactaaaacatacaaaaattagccgggcatggtgcacacgcctgtagtcccagctactcaggaggctgaggcaggagaatcgcttgaacctgggaggcagaggttgcagtgaacctagattgcaccattgcactctagcctggcaacagaggcagattccctcctgcc

SEQ ID NO: 2968 - DNA, 1467 bp; single-stranded, linear
cgggaggcggaggttgcggtgagctgagatcacgccactgcactccagcctgggcagcaagagtgaaactccatctgaaaaaaaaaaaaagattcaacatgaacttctgaggggacatcatcattctaaccatggcaaggagtcttggaactgatgaaatggaacagtcccttcttgtccctttattaaccagaatttttgtgtggtcttccaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcacaggccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaacatcatggactgagctgggggaagaagggatatctactgtggtctgggcaccacctctgtgggcactggtgggccattagatttggaggctacctcacctgggcagggatgatggcagacgaggctgttggaaaatccagaactcaaat

SEQ ID NO: 2969 - DNA, 4311 bp; single-stranded, linear
ccagctgatattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactctaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccttgcttcttcacgagggctggggccaggacccagacagagacacacggtcactgcagctgaagccgctgcccctgctacaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaaacatcatgactgagctgggggaagaagggatatctactgtgggtctgggcaccacctctgtggcactggtgggccattagatttggaggctacctcacctgggcagggatgatgcagagccaggctgttggaaaatccagaactcaaatgagccccttcatccgcctgtgggcgcatactacagtaactgtgactgatgactttatcctgagtcccttaatcttatggggccggaaggaatgtcagggccaggtgcagaccttgggggaagactttaaaccacctagttctcccactggggcatcggtctaaagctttgggggagtggccccagtggctcacacctgtaatcccagcactttgggaggccgaggtgggcagatcatgggtcaagagatcgagacatcctggccaacattgtaaaaccccatctctactaaaacatacaaaaattagccgggcatggtgcacacgcctgtagtcccagctactcaggaggctgaggcaggagaatcgcttgaacctgggaggcagaggttgcagtgaacctagattgcaccattgcactctagcctggcaacagaggcagattccctcctgcccgggaggcggaggttgcggtgagctgagatcacgccactgcactccagcctgggcagcaagagtgaaactccatctgaaaaaaaaaaaaagattcaacatgaacttctgaggggacatcatcattctaaccatggcaaggagtcttggaactgatgaaatggaacagtcccttcttgtccctttattaaccagaatttttgtgtggtcttccaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcacaggccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaacatcatggactgagctgggggaagaagggatatctactgtggtctgggcaccacctctgtgggcactggtgggccattagatttggaggctacctcacctgggcagggatgatggcagacgaggctgttggaaaatccagaactcaaat

SEQ ID NO: 2970 - DNA, 827 bp; single-stranded, linear
ctcctcctgcacaccttccgcacacctccctcgctctcccacaccactggcaccaggccccgcacacctgctcggctgcaggagaatggctactcatcacacgctgtggatgggactggtcctgctggggctgctgggcggcctacaggcagcacccgaggcccaggtctccgtgcagcccaacttccagccggacaagttcctggggcgctggttcagcgcgggcctcgcctccaactcgagctggctccaggagaagaaggcagcgctgtccatgtgcaagtcggtggtggcccctgcggcggatggtggcttcaacctgacctccaccttcctcaggaaaaaccagtgtgagacccgaaccatgctgctgcagcccggggactccctcggctcctacagctaccggagtccccactggggcagcacctactctgtgtcagtggtggagactgactacgaccactacgccctgctgtacagccagggcagcaagggccccggcgaggacttccgcatggccaccctctacagccgaacccagacccccagggctgagttaaaggagaaatttaccgccttctgcaaggcccagggcttcacagaggattccattgtcttcctgccccaaaccgataagtgcatgacggaacaataggactccccagagctgaagctgggaccgcagccagccaggtgacccctgcgatctggatgtttccgctctgttccttccccgagcccctgccccggctccccgccaaagcacccctgccccctcgggcttcctcctggctctgcggaataaactccggaagcaagtctgt

SEQ ID NO: 2971 - DNA, 2245 bp; single-stranded, linear
ggagcaagaggtggttggggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctgggggtttgggaaacaaggcttccagtgccaagtttgctgttttgtggtccacaagaggtgccatgaatttgttactttttcttgtccgggtgcggataagggacccgacactgatgaccccaggagcaagcacaagttcaaaatccacacttacggaagccccaccttctgcgatcactgtgggtcactgctctatggacttatccatcaagggatgaaatgtgacacctgcgatatgaacgttcacaagcaatgcgtcatcaatgtccccagcctctgcggaatggatcacactgagaagagggggcggatttacctaaaggctgaggttgctgatgaaaagctccatgtcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattcaaattgaaaccttcagacaaagaccgacgactgtctgtagaaatctgggactgggatcgaacaacaaggaatgacttcatgggatccctttcctttggagtttcggagctgatgaagatgccggccagtggatggtacaagttgcttaaccaagaagaaggtgagtactacaacgtacccattccggaaggggacgaggaaggaaacatggaactcaggcagaaattcgagaaagccaaacttggccctgctggcaacaaagtcatcagtccctctgaagacaggaaacaaccttccaacaaccttgaccgagtgaaactcacggacttcaatttcctcatggtgttgggaaaggggagttttggaaaggtgatgcttgccgacaggaagggcacagaagaactgtatgcaatcaaaatcctgaagaaggatgtggtgattcaggatgatgacgtggagtgcaccatggtagaaaagcgagtcttggccctgcttgacaaacccccgttcttgacgcagctgcactcctgcttccagacagtggatcggctgtacttcgtcatggaatatgtcaacggtggggacctcatgtaccacattcagcaagtaggaaaatttaaggaaccacaagcagtattctatgcggcagagatttccatcggattgttctttcttcataaaagaggaatcatttatagggatctgaagttagataacgtcatgttggattcagaaggacatatcaaaattgctgactttgggatgtgcaaggaacacatgatggatggagtcacgaccaggaccttctgtgggactccagattatatcgccccagagataatcgcttatcagccgtatggaaaatctgtggactggtgggcctatggcgtcctgttgtatgaaatgcttgccgggcagcctccatttgatggtgaagatgaagacgagctatttcagtctatcatggagcacaacgtttcctatccaaaatccttgtccaaggaggctgtttctatctgcaaaggactgatgaccaaacacccagccaagcggctgggctgtgggcctgagggggagagggacgtgagagagcatgccttcttccggaggatcgactgggaaaaactggagaacagggagatccagccaccattcaagcccaaagtgtgtggcaaaggagcagagaactttgacaagttcttcacacgaggacagcccgtcttaacaccacctgatcagctggttattgctaacatagaccagtctgattttgaagggttctcgtatgtcaacccccagtttgtgcaccccatcttacagagtgcagtatgaaactcaccagcgagaacaaacacctccccagcccccagccctccccgcagtggaagtgaatccttaaccctaaaattttaaggccacggcttgtgtctgattccatatggaggcctgaaaattgtagggttattagtccaaatgtgatcaactgttcagggtctctctcttacaaccaagaacattatcttagtggaag

SEQ ID NO: 2972 - DNA, 636 bp; single-stranded, linear
cttatcacagttcaagtgatttccagaagttccagggcttctgagagaccatcaagggaactttaacaacttgacaaatgtccttgaagtaagatgcctcatctttagggaaaaatggggtttggatttctgcttaggcaaagtctcctgcagttcatccttctctgtcctcttcttgcttcaggcttggggaccgtccctgctgtccccactgtggtggcaatcaggacctaaggtgaagcaaacttgaagttctatctgacaagtttaggcagtaagagaaggagggaaatcggagcaaagctccctcactttattgttgagaaactggcatctggaaagaagaaggaatttgcccaaagtcagtcagctgggataaaaacctgggtgtcctgtccagaaagtgcagggtgctttctgctctgtagcaaggcagcagacatctctgagccaggcccaccaacaggcccttatctggtggttggatcatgatcccattttgcttggacatgctctcaggaagataaaaaccatggagaaacactaggccattgacaaatgatctgagacaactttagaaaacaatgtaggatgaatggaaagagaaagaaaggaaagaaaaaaaaaaaaaaaagg

SEQ ID NO: 2973 - DNA, 2574 bp; single-stranded, linear
cagagccggcgcaggggaagcgcccggggccccgggtgcagcagcgcccgccgcctcccgggcctccccggcccgcagcccggggtcccgggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaggccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagaggcctttcttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagcttcggaattc

SEQ ID NO: 2974 - DNA, 3321 bp; single-stranded, linear
cagagccggcgcaggggaagcgcccggggccccgggtgcagcagcgcccgccgcctcccgggcctccccggcccgcagcccggggtcccgggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaggccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagcttgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccggtcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaaagaaaaaaaaaggtgactcacattgttacacatgctttaaaatatgtgttcaaatgttattaaccacaatgacgacctgttttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgag

SEQ ID NO: 2975 - DNA, 621 bp; single-stranded, linear
gtccttcattccttccacaactatttatccagcaccgtttctgggcacagggctccagcgatggtcccaacaggtacaatgacctctggggaccaagttcagttcttggtgagttctccagtgcctctcgatgtaggatgaaccgttggcatgctccactgacgctggctccttctgttgtttctcttggctccaggacccccgcagcaaacacaagtttaagatccacacgtactccagccccacgttttgtgaccactgtgggtcactgctgtatggactcatccaccaggggatgaaatgtgacagtaagtactttctctctctgggggcatctgctgatggcagaagcaatgggaagggctgcttccacttggtttggggtccaggtctgccatacattcccccctgtcctcgttggggctggtgtaccagttatctgttgctgcataatgatcctcccaccccaaaacactgtgactgaagacaataaacatttttttagctcatgactctgcaaggcagtcctttgaatctgggctggcctcagctgatgtcacgcatgttcataaagcatgaactcatggttcatggtggattagcagatggaggtgggctggg

SEQ ID NO: 2976 - DNA, 1559 bp; single-stranded, linear
acatcaaggagacgagtcctggttggatagtaatgtctttaacacccctctagcatttattaatttcctctcttaacaaataaaagatgcccttcagtcagatgcttaggacagatgacgcacctagagatattttaataatgtagatactcttgctgttcaaactcagaccaaaatgacgataggcttttttggcccccagagggtgcacaaatacgaccagaatttgtgaagacgagtcagaaatgaatgaaatttggaaaaatattgatctactgaaatccttcctccccacactattagccctatgttacagttggggaaacggagtcgttttgcagaggggatggacagaaggtagggagttctcttccaaacgtgcaggaggcaagcaaagccaagaatcttctctgtggtgagttagagacatataaaataaagatcgctcctcccctacctctgcagaacgtgtgtgtgtatgtgtgtgtaagtgtgtgcggccacaagcctttccgaatgagtgacagcgggagcccatccctccaggagacgcgtgcagaatgaccaatgggatggatgggggtggatgggtaccagtctccgcagaggccggggtgggaattcgctgcgccccaccccttccacccgctccccttcgccccgtaggtctttccactctcgctcctcccctgggcacatctcctgaacgcagccccgggggccgaggacggggtggggtggggggcgaggctcgggtccgacgaccccgggctgcggtcccggcgctgcagagctgcggctgtgcacgcttagccgcgaggcccgcggtagcccgggcgccgatatgtaaagcagctggcagcgctgggcggggcctgggcgcgactgcaaatgaggagggcgcgggctggcccgggggctccgcctccctcccccgcagctggggccagcggctgccaagcgcactggtcgagcggcagcagctgggcgaggtgacagccccggctccgcgcgccggccgccagagccggcgcaggggaagcgcccgcggccccgggtgcagcagcggccgccgcctcccgcgcctccccggcccgcagcccgcggtcccgcgccccggggccggcacctctcgggctccggctccccgcgcgcaagatggctgacccggctgcggggccgccgccgagcgagggcgaggagagcaccgtgcgcttcgcccgcaaaggcgccctcaggcagaagaacgtgcatgaggtcaagaaccacaaattcaccgcccgcttcttcaagcagcccaccttctgcagccactgcaccgacttcatctggtgaccccccaggcactccggccccaggccacgccgcgccaggaccccctctccgcgccctctgcgccctccgcaccctggaccccgcgtccccggactccccgctccggaccctgctgcccgggactcccggatggacagtcctagccgttgccctgtccccaccctggtcccagacgggccgccgcgggcgcctcctgccctctcctgctctcaggcgcctctaga

SEQ ID NO: 2977 - DNA, 2510 bp; single-stranded, linear
gtcgactgcaggtcaacggacacatcaaggagagagtcctggttggatagtaatgtctttaacacccctctagcatttattaatttcctctcttaacaaataaaagatgacttcagttgaagatccttaggacagatgacggcacctggagatattttaataatgtagataccctcttgctgttcaaactcagaccaaaagagatggctttttttcccccagagggtgcacaaatacgacagaatttgtgaagacgagtcagaaatgaatgaaatttggaaaaatattgatctactgaaatccttcctccccacactattagccctatgttacagttggggaaacggagtcgttttgcagaggggatggacagaaggtagggagttctcttccaacgtgcaggaggcaagcaaagccaagcatcttctctgtggtggagttagagacatataaaataagatcgctcctcccctacctctgcagaacgtgtgtgtgtatgtgtgtgtaacgtgtgtgcggccacaagcctttccgaatgagtgacagcgggagcccatccctccaggagacgcgtgcagaatgaccaatgggatggatgggggtggatgggtaccgtctccgcgaggccggggtggaattcgctgcgccccaccccttccacccgctccccttcgccccgtaggtctttccactctcgctcctcccctgggcacatctcctgaacgcagccccgggggccgaggacggggtggggtggggggcgaggctcgggtccgacgaccccgggctgcggtcccggcgctgcagagctgcggctgtgcacgcttagccgcgaggcccgcggtagcccgggcgccgatatgtaaagcagctggcagcgctgggcggggcctgggcgcgatgcaaatgaggagggcggggctggcccggggctccgcctccctcccccgcagctggggccagcggtgccaagcgcagctggacgagcggcagcagctgggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctcaggcagaagaacgtgcatgaggtcaagaaccacaaattcaccgcccgcttcttcaagcagcccaccttctgcagccactgcaccgacttcatctggtggagcgcgcgcgcaaggcaccttcccgggcccccgaggcagcgccgcgccaagggaccccctctccgccctctgcgccctccgcaccctggaccccgcgtccccggactccccgctccggaccctgctgccgggactcccggatggacagtcctgccgttgccctgtccccaccctggtcccaggacgggggcgcctcctgccctctcctgctctcaggcgcctctagagcgcccaggggcagcgtcgcgggcgcctttgctccacctgactaggagcgcgcggggtctgtgcctgccctggagggcagcgcctcgggtgctctccgacccggggttccctatctctccgcctgcttccgggcgcgaggagccctcgccccccaccccttgtttccggggggggggggcggcgccctgggtgtccttctctatctctgcgggcatgggacatcctttctcactcctctgtgcctcggcagcgccctgtgttatctcccattgccctccccgagggcctggttcccctttccactcctcggtcacatcactgcgggcccctttcttccccagtccctccagtagtggggcatcctttcctccttcccagtccccctcccagaggacaccaccgccgcggggtcactctcgccctccctctgaatgcgtctttatctcttctcttttccgagggtgctcggggcatctatgggtacatctgtcgcctgccttcagcccctaccccgacggaaacgctccccactatcccgccacctggtggtcgcagcctcctctcttctgcaggagtgaaggcagatcggggttacagccgagctcccacctacccccacaaaggcggaagactcttgggcacccgcctgtggctgggagtttgcacctggggtacagaggcagggaggaaggcgggtgactctgtgggtaactagctggaggctgggcccccgggctgcctgacatacacctccttctgcttttgcaggggcttcgggaagcagggattccagtgccaaggtaggctctggggctttggggatgctatttgtgggaagagagggtgaaaaatactttatagaagaagttactgagttaggcagagagtgaaagaatcacgttggtcggagtgacctcccaggctaggaattc

SEQ ID NO: 2978 - DNA, 2163 bp; single-stranded, linear
aaagcgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatactttagagcacaatgga

SEQ ID NO: 2979 - DNA, 2104 bp; single-stranded, linear
tgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacaatctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactctgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggaatgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagat

SEQ ID NO: 2980 - DNA, 2146 bp; single-stranded, linear
cccaagatggaagggagcggcggccgcgtccgcctcaaggcgcattacgggggggacatcttcatcaccagcgtggacgccgccacgaccttcgaggagctctgtgaggaagtgagagacatgtgtcgtctgcaccagcagcacccgctcaccctcaagtgggtggacagcgaaggtgacccttgcacggtgtcctcccagatggagctggaagaggctttccgcctggcccgtcagtgcagggatgaaggcctcatcattcatgttttcccgagcacccctgagcagcctggcctgccatgtccgggagaagacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctggcccggcaggcagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgaaaaaaaaaa

SEQ ID NO: 2981 - DNA, 1423 bp; single-stranded, linear
gggccggcggcggcggcgactctggacgcgagccgggcccttcccgtggatcgccccagctgcggcgggcgtcgcggccgcccccgggtggcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgct

SEQ ID NO: 2982 - DNA, 2244 bp; single-stranded, linear
ctccccgccccgaccatggtagtgttcaatggccttcttaagatcaaaatctgcgaggccgtgagcttgaagcccacagcctggtcgctgcgccatgcggtgggaccccggccgcagactttccttctcgacccctacattgccctcaatgtggacgactcgcgcatcggccaaacggccaccaagcagaagaccaacagcccggcctggcacgacgagttcgtcaccgatgtgtgcaacggacgcaagatcgagctggctgtctttcacgatgcccccataggctacgacgacttcgtggccaactgcaccatccagtttgaggagctgctgcagaacgggagccgccacttcgaggactggattgatctggagccagaaggaagagtgtatgtgatcatcgatctctcagggtcgtcgggtgaagcccctaaagacaatgaagagcgtgtgttcagggaacgcatgcggccgaggaagcggcagggggccgtcaggcgcagggtccatcaggtcaacggccacaagttcatggccacctatcttcggcagcccacctactgctcccattgcagagacttcatctggggtgtcataggaaagcagggataccagtgtcaagtctgcacctgcgtggtccacaagcggtgccacgagctcataatcacaaagtgtgctgggttaaagaagcaggagacccccgaccaggtgggctcccagcggttcagcgtcaacatgccccacaagttcggtatccacaactacaaggtccctaccttctgcgatcactgtgggtccctgctctggggactcttgcggcagggtttgcagtgtaaagtctgcaaaatgaatgttcaccgtcgatgtgagaccaacgtggctcccaactgtggagtggatgccagaggaatcgccaaagtactggccgacctgggcgttaccccagacaaaatcaccaacagcggccagagaaggaaaaagctcattgctggtgccgagtccccgcagcctgcttctggaagctcaccatctgaggaagatcgatccaagtcagcacccacctccccttgtgaccaggaaataaaagaacttgagaacaacattcggaaagccttgtcatttgacaaccgaggagaggagcaccgggcagcatcgtctcctgatggccagctgatgagccccggtgagaatggcgaagtccggcaaggccaggccaagcgcctgggcctggatgagttcaacttcatcaaggtgttgggcaaaggcagctttggcaaggtcatgttggcagaactcaagggcaaagatgaagtatatgctgtgaaggtcttaaagaaggacgtcatccttcaggatgatgacgtggactgcacaatgacagagaagaggattttggctctggcacggaaacacccgtaccttacccaactctactgctgcttccagaccaaggaccgcctctttttcgtcatggaatatgtaaatggtggagacctcatgtttcagattcagcgctcccgaaaattcgacgagcctcgttcacggttctatgctgcagaggtcacatcggccctcatgttcctccatcagcatggagtcatctacagggatttgaaactggacaacatccttctggatgcagaaggtcactgcaagctggctgacttcgggatgtgcaaggaagggattctgaatggtgtgacgaccaccacgttctgtgggactcctgactacatagctcctgagatcctgcaggagttggagtatggcccctccgtggactggtgggccctgggggtgctgatgtacgagatgatggctggacagcctccctttgaggccgacaatgaggacgacctatttgagtccatcctccatgacgacgtgctgtacccagtctggctcagcaaggaggctgtcagcatcttgaaagctttcatgacgaagaatccccacaagcgcctgggctgtgtggcatcgcagaatggcgaggacgccatcaagcagcacccattcttcaaagagattgactgggtgctcctggagcagaagaagatcaagccacccttcaaaccacgcattaaaaccaaaagagacgtcaataattttgaccaagactttacccgggaagagccggtactcacccttgtggacgaagcaattgtaaagcagatcaaccaggaggaattcaaaggtttctcctactttggtgaagacctgatgccctgagagcccactgcagtt

SEQ ID NO: 2983 - DNA, 218 bp; single-stranded, linear
agccggcttctggaaactccctgtgtgagtgtgagggaatgagtatgaacaaggcacattatgtcttacttattgtattagtttcctgttgctgctgtagcaagttaccaccaatttatggcttaaagcaattcaaattttttctcttgaattcttaagatcagaagttctaaatgagtctaatggggctaaaatcaaggtgttaggcaaaggcagct

SEQ ID NO: 2984 - DNA, 1830 bp; single-stranded, linear
tgcagctggagatccgggctcccacagcagatgagatccacgtaactgttggcgaggcccgtaacctaattcctatggaccccaatggtctctctgatccctatgtgaaactgaagctcatcccagaccctcggaacctgacgaaacagaagacccgaacggtgaaagccacgctaaaccctgtgtggaatgagacctttgtgttcaacctgaagccaggggatgtggagcgccggctcagcgtggaggtgtgggactgggaccggacctcccgcaacgacttcatgggggccatgtcctttggcgtctcggagctgctcaaggcgcccgtggatggctggtacaagttactgaaccaggaggagggcgagtattacaatgtgccggtggccgatgctgacaactgcagcctcctccagaagtttgaggcttgtaactaccccctggaattgtatgagcgggtgcggatgggcccctcttcctctcccatcccctccccttcccctagtcccaccgaccccaagcgctgcttcttcggggcgagtccaggacgcctgcacatctccgacttcagcttcctcatggttctaggaaaaggcagttttgggaaggtgatgctggccgagcgcaggggctctgatgagctctacgccatcaagatcttgaaaaaggacgtgatcgtccaggacgacgatgtggactgcacgctggtggagaaacgtgtgctggcgctggggggccggggtcctggcggccggccccacttcctcacccagctccactccaccttccagaccccggaccgcctgtatttcgtgatggagtacgtcaccgggggagacttgatgtaccacattcaacagctgggcaagtttaaggagccccatgcagcgttctacgcggcagaaatcgctatcggcctcttcttccttcacaatcagggcatcatctacagggacctgaagctggacaatgtgatgctggatgctgagggacacatcaagatcactgactttggcatgtgtaaggagaacgtcttccccgggacgacaacccgcaccttctgcgggaccccggactacatagccccggagatcattgcctaccagccctatgggaagtctgtcgattggtggtcctttggagttctgctgtatgagatgttggcaggacagcctcccttcgatggggaggacgaggaggagctgtttcaggccatcatggaacaaactgtcacctaccccaagtcgctttcccgggaagccgtggccatctgcaaggggttcctgaccaagcacccagggaagcgcctgggctcagggcctgatggggaacctaccatccgtgcacatggctttttccgctggattgactgggagcggctggaacgattggagatcccgcctcctttcagaccccgcccgtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatgtaatctcacccgccgccactaggtgtccccaacgtcccctccgccgtgccggcggcagccccacttcacccccaacttcaccaccccctgtcccattctagatcctgcaccccagcattccagctctgcccccgcgggttctagacgcccctcccaagcgttcctggccttctgaactccatacagcctctacagccgtcccgcgttcaagacttgagcg

SEQ ID NO: 2985 - DNA, 2196 bp; single-stranded, linear
cggggtgtcttgggcccgggcggctgtagaggcggcggcgcctacgggcagtgggaggagccgcgcggttccggctgctccggcgaggcgacccttgggtcggcgctgcgggcaggtggcaggtaggtggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcggggatatcatgataacacattttgaaccttccatctcctttgagggcctttgcaatgaggttcgagacatgtgttcttttgacaacgaacagctcttcaccatgaaatggatagatgaggaaggagacccgtgtacagtatcatctcagttggagttagaagaagcctttagactttatgagctaaacaaggattctgaactcttgattcatgtgttcccttgtgtaccagaacgtcctgggatgccttgtccaggagaagataaatccatctaccgtagaggtgcacgccgctggagaaagctttattgtgccaatggccacactttccaagccaagcgtttcaacaggcgtgctcactgtgccatctgcacagaccgaatatggggacttggacgccaaggatataagtgcatcaactgcaaactcttggttcataagaagtgccataaactcgtcacaattgaatgtgggcggcattctttgccacaggaaccagtgatgcccatggatcagtcatccatgcattctgaccatgcacagacagtaattccatataatccttcaagtcatgagagtttggatcaagttggtgaagaaaaagaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctcgacccggaat

SEQ ID NO: 2986 - DNA, 2389 bp; single-stranded, linear
gaattcggacggaggaggcagaatggccagtcgaggggcgcttaggcgtggcctttccccagggctgcctcgactcctgcacctgtcccgagggctggcctgagacgggactcccggttctcccgctgcgaagcaggccccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacccccctgggctacgacttcgtggccaactgcaccctgcagttccaggagctcgtcggcacgaccggcgcctcggacaccttcgagggttgggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgctggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaatgaagatgacctctttgaggccatactgaatgatgaggtggtctaccctacctggctccatgaagatgccacagggatcctaaaatctttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaaggaatagagattctccaggaatttcctctatcggaccttcccagcatcagccttagaacaagaaccttaccttcaaggagcaagtgaagaactctgtcgaaggatggaactttcagatatcaactatttagagtcc

SEQ ID NO: 2987 - DNA, 3742 bp; single-stranded, linear
gaattccttctctcctcctcctcgcccttctcctcgccctcctcctcctcctcgccctcccctcccgatcctcatccccttgccctcccccagcccagggacttttccggaaagtttttattttccgtctgggctctcggagaaagaagctcctggctcagcggctgcaaaactttcctgctgccgcgccgccagcccccgccctccgctgcccggccctgcgccccgccgagcgatgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgaccagaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcacgttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggagatttgcttagccctggggcagagtctgatgtggtcatggaagaagggagtgatgacaatgatagtgaaaggaacagtgggctcatggatgatatggaagaagcaatggtccaagatgcagagatggcaatggcagagtgccagaacgacagtggcgagatgcaagatccagacccagaccacgaggacgccaacagaaccatcagtccatcaacaagcaacaatatcccactcatgagggtagtgcagtctgtcaaacacacgaagaggaaaagcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagagatatctctgtgagtatttcagtatcaaattgccagattcaagaaaatgtggacatcagcacagtatatcagatttttcctgatgaagtactgggttctggacagtttggaattgtttatggaggaaaacatcgtaaaacaggaagagatgtagctattaaaatcattgacaaattacgatttccaacaaaacaagaaagccagcttcgtaatgaggttgcaattctacagaaccttcatcaccctggtgttgtaaatttggagtgtatgtttgagacgcctgaaagagtgtttgttgttatggaaaaactccatggagacatgctggaaatgatcttgtcaagtgaaaagggcaggttgccagagcacataacgaagtttttaattactcagatactcgtggctttgcggcaccttcattttaaaaatatcgttcactgtgacctcaaaccagaaaatgtgttgctagcctcagctgatccttttcctcaggtgaaactttgtgattttggttttgcccggatcattggagagaagtctttccggaggtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagccattgatcttatcaacaatttgctgcaagtaaaaatgagaaagcgctacagtgtggataagaccttgagccacccttggctacaggactatcagacctggttagatttgcgagagctggaatgcaaaatcggggagcgctacatcacccatgaaagtgatgacctgaggtgggagaagtatgcaggcgagcagcggctgcagtaccccacacacctgatcaatccaagtgctagccacagtgacactcctgagactgaagaaacagaaatgaaagccctcggtgagcgtgtcagcatcctctgagttccatctcctataatctgtcaaaacactgtggaactaataaatacatacggtcaggtttaacatttgccttgcagaactgccattattttctgtcagatgagaacaaagctgttaaactgttagcactgttgatgtatctgagttgccaagacaaatcaacagaagcatttgtattttgtgtgaccaactgtgttgtattaacaaaagttccctgaaacacgaaacttgttattgtgaatgattcatgttatatttaatgcattaaacctgtctccactgtgcctttgcaaatcagtgtttttcttactggagcttcattttggtaagagacagaatgtatctgtgaagtagttctgtttggtgtgtcccattggtgttgtcattgtaaacaaactcttgaagagtcgattatttccagtgttctatgaacaactccaaaacccatgtgggaaaaaaatgaatgaggagggtagggaataaaatcctaagacacaaatgcatgaacaagttttaatgtatagttttgaatcctttgcctgcctggtgtgcctcagtatatttaaactcaagacaatgcacctagctgtgcaagacctagtgctcttaagcctaaatgccttagaaatgtaaactgccatatataacagatacatttccctctttcttataatactctgttgtactatggaaaatcagctgctcagcaacctttcacctttgtgtatttttcaataataaaaaatattcttgtcaaaaaaaaaaaaa

SEQ ID NO: 2988 - DNA, 2705 bp; single-stranded, linear
tgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgactttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaacgaaatgcttgttgaatcaggggcaaacggagtacagacgtctcaagactgaaacggccccattgcctggtctagtagcggatctcactcagccgcagacaagtaatcactaacccgttttattctatcctatctgtggatgtataaatgctgggggccagccctggataggtttttatgggaattctttacaataaacatagcttgtacttg

SEQ ID NO: 2989 - DNA, 1779 bp; single-stranded, linear
atgcccagcaggaccgaccccaagatggaagggagcggcggccgcgtccgcctcaaggcgcattacgggggggacatcttcatcaccagcgtggacgccgccacgaccttcgaggagctctgtgaggaagtgagagacatgtgtcgtctgcaccagcagcacccgctcaccctcaagtgggtggacagcgaaggtgacccttgcacggtgtcctcccagatggagctggaagaggctttccgcctggcccgtcagtgcagggatgaaggcctcatcattcatgttttcccgagcacccctgagcagcctggcctgccatgtccgggagaagacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggacgtacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacggacacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtga

SEQ ID NO: 2990 - DNA, 239 bp; single-stranded, linear
tgtcatgccttcccaagagcctccaggatggctgtcctccgacctcctccacctccaggctctagatggcaaagcccacttagcaaaagccacctgctctgtgatgatgggactggctcctgcctgtgggttcggaaagcccatcccaccctctacagcctcttgctcctctgcaatgactgtgccttcacctgggggttccccagagactagtgagagtcatcgggcgtggaagctat

SEQ ID NO: 2991 - DNA, 38644 bp; single-stranded, linear
ggagcaagaggtggttggggggggaccatggctgacgttttcccgggcaacgactccacggcgtctcaggacgtggccaaccgcttcgcccgcaaaggggcgctgaggcagaagaacgtgcacgaggtgaaggaccacaaattcatcgcgcgcttcttcaagcagcccaccttctgcagccactgcaccgacttcatctgggggtttgggaaacaaggcttccagtgccaagtttgctgttttgtggtccacaagaggtgccatgaatttgttactttttcttgtccgggtgcggataagggacccgacactgatgaccccaggagcaagcacaagttcaaaatccacacttacggaagccccaccttctgcgatcactgtgggtcactgctctatggacttatccatcaagggatgaaatgtgacacctgcgatatgaacgttcacaagcaatgcgtcatcaatgtccccagcctctgcggaatggatcacactgagaagagggggcggatttacctaaaggctgaggttgctgatgaaaagctccatgtcacagtacgagatgcaaaaaatctaatccctatggatccaaacgggctttcagatccttatgtgaagctgaaacttattcctgatcccaagaatgaaagcaagcaaaaaaccaaaaccatccgctccacactaaatccgcagtggaatgagtcctttacattcaaattgaaaccttcagacaaagaccgacgactgtctgtagaaatctgggactgggatcgaacaacaaggaatgacttcatgggatccctttcctttggagtttcggagctgatgaagatgccggccagtggatggtacaagttgcttaaccaagaagaaggtgagtactacaacgtacccattccggaaggggacgaggaaggaaacatggaactcaggcagaaattcgagaaagccaaacttggccctgctggcaacaaagtcatcagtccctctgaagacaggaaacaaccttccaacaaccttgaccgagtgaaactcacggacttcaatttcctcatggtgttgggaaaggggagttttggaaaggtgatgcttgccgacaggaagggcacagaagaactgtatgcaatcaaaatcctgaagaaggatgtggtgattcaggatgatgacgtggagtgcaccatggtagaaaagcgagtcttggccctgcttgacaaacccccgttcttgacgcagctgcactcctgcttccagacagtggatcggctgtacttcgtcatggaatatgtcaacggtggggacctcatgtaccacattcagcaagtaggaaaatttaaggaaccacaagcagtattctatgcggcagagatttccatcggattgttctttcttcataaaagaggaatcatttatagggatctgaagttagataacgtcatgttggattcagaaggacatatcaaaattgctgactttgggatgtgcaaggaacacatgatggatggagtcacgaccaggaccttctgtgggactccagattatatcgccccagagataatcgcttatcagccgtatggaaaatctgtggactggtgggcctatggcgtcctgttgtatgaaatgcttgccgggcagcctccatttgatggtgaagatgaagacgagctatttcagtctatcatggagcacaacgtttcctatccaaaatccttgtccaaggaggctgtttctatctgcaaaggactgatgaccaaacacccagccaagcggctgggctgtgggcctgagggggagagggacgtgagagagcatgccttcttccggaggatcgactgggaaaaactggagaacagggagatccagccaccattcaagcccaaagtgtgtggcaaaggagcagagaactttgacaagttcttcacacgaggacagcccgtcttaacaccacctgatcagctggttattgctaacatagaccagtctgattttgaagggttctcgtatgtcaacccccagtttgtgcaccccatcttacagagtgcagtatgaaactcaccagcgagaacaaacacctccccagcccccagccctccccgcagtggaagtgaatccttaaccctaaaattttaaggccacggcttgtgtctgattccatatggaggcctgaaaattgtagggttattagtccaaatgtgatcaactgttcagggtctctctcttacaaccaagaacattatcttagtggaagcttatcacagttcaagtgatttccagaagttccagggcttctgagagaccatcaagggaactttaacaacttgacaaatgtccttgaagtaagatgcctcatctttagggaaaaatggggtttggatttctgcttaggcaaagtctcctgcagttcatccttctctgtcctcttcttgcttcaggcttggggaccgtccctgctgtccccactgtggtggcaatcaggacctaaggtgaagcaaacttgaagttctatctgacaagtttaggcagtaagagaaggagggaaatcggagcaaagctccctcactttattgttgagaaactggcatctggaaagaagaaggaatttgcccaaagtcagtcagctgggataaaaacctgggtgtcctgtccagaaagtgcagggtgctttctgctctgtagcaaggcagcagacatctctgagccaggcccaccaacaggcccttatctggtggttggatcatgatcccattttgcttggacatgctctcaggaagataaaaaccatggagaaacactaggccattgacaaatgatctgagacaactttagaaaacaatgtaggatgaatggaaagagaaagaaaggaaagaaaaaaaaaaaaaaaaggcagagccggcgcaggggaagcgcccggggccccgggtgcagcagcgcccgccgcctcccgggcctccccggcccgcagcccggggtcccgggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaggccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagctagagacaagagagacacctccaacttcgacaaagagttcaccagacagcctgtggaactgacccccactgataaactcttcatcatgaacttggaccaaaatgaatttgctggcttctcttatactaacccagagtttgtcattaatgtgtaggtgaatgcaaactccatcgttgagcctggggtgtaagacttcaagccaagcgtatgtatcaattctagtcttccaggattcacggtgcacatgctggcattcaacatgtggaaagcttgtcttagaggcctttcttgtatgtgtagcttgctagtttgttttctacatttgaaaatgtttagtttagaataagcgcattatccaattatagaggtacaattttccaaacttccagaaactcatcaaatgaacagacaatgtcaaaactactgtgtctgataccaaaatgcttcagtatttgtaatttttcaagtcagaagctgatgttcctggtaaaagtttttacagttattctataatatcttctttgaatgctaagcatgagcgatatttttaaaaattgtgagtaagcttcggaattccagagccggcgcaggggaagcgcccggggccccgggtgcagcagcgcccgccgcctcccgggcctccccggcccgcagcccggggtcccgggccccggggccggcacctctcgggctccggctccccgcgcgcaagatggctgacccggctgcggggccgccgccgagcgagggcgaggagagcaccgtgcgcttcgcccgcaaaggcgccctccggcagaagaacgtgcatgaggtcaagaaccacaaattcaccgcccgcttcttcaagcagcccaccttctgcagccactgcaccgacttcatctggggcttcgggaagcagggattccagtgccaagtttgctgctttgtggtgcacaagcggtgccatgaatttgtcacattctcctgccctggcgctgacaagggtccagcctccgatgacccccgcagcaaacacaagtttaagatccacacgtactccagccccacgttttgtgaccactgtgggtcactgctgtatggactcatccaccaggggatgaaatgtgacacctgcatgatgaatgtgcacaagcgctgcgtgatgaatgttcccagcctgtgtggcacggaccacacggagcgccgcggccgcatctacatccaggcccacatcgacagggacgtcctcattgtcctcgtaagagatgctaaaaaccttgtacctatggaccccaatggcctgtcagatccctacgtaaaactgaaactgattcccgatcccaaaagtgagagcaaacagaagaccaaaaccatcaaatgctccctcaaccctgagtggaatgagacatttagatttcagctgaaagaatcggacaaagacagaagactgtcagtagagatttgggattgggatttgaccagcaggaatgacttcatgggatctttgtcctttgggatttctgaacttcagaaggccagtgttgatggctggtttaagttactgagccaggaggaaggcgagtacttcaatgtgcctgtgccaccagaaggaagtgaggccaatgaagaactgcggcagaaatttgagagggccaagatcagtcagggaaccaaggtcccggaagaaaagacgaccaacactgtctccaaatttgacaacaatggcaacagagaccggatgaaactgaccgattttaacttcctaatggtgctggggaaaggcagctttggcaaggtcatgctttcagaacgaaaaggcacagatgagctctatgctgtgaagatcctgaagaaggacgttgtgatccaagatgatgacgtggagtgcactatggtggagaagcgggtgttggccctgcctgggaagccgcccttcctgacccagctccactcctgcttccagaccatggaccgcctgtactttgtgatggagtacgtgaatgggggcgacctcatgtatcacatccagcaagtcggccggttcaaggagccccatgctgtattttacgctgcagaaattgccatcggtctgttcttcttacagagtaagggcatcatttaccgtgacctaaaacttgacaacgtgatgctcgattctgagggacacatcaagattgccgattttggcatgtgtaaggaaaacatctgggatggggtgacaaccaagacattctgtggcactccagactacatcgcccccgagataattgcttatcagccctatgggaagtccgtggattggtgggcatttggagtcctgctgtatgaaatgttggctgggcaggcaccctttgaaggggaggatgaagatgaactcttccaatccatcatggaacacaacgtagcctatcccaagtctatgtccaaggaagctgtggccatctgcaaagggctgatgaccaaacacccaggcaaacgtctgggttgtggacctgaaggcgaacgtgatatcaaagagcatgcatttttccggtatattgattgggagaaacttgaacgcaaagagatccagcccccttataagccaaaagcttgtgggcgaaatgctgaaaacttcgaccgatttttcacccgccatccaccagtcctaacacctcccgaccaggaagtcatcaggaatattgaccaatcagaattcgaaggattttcctttgttaactctgaatttttaaaacccgaagtcaagagctaagtagatgtgtagatctccgtccttcatttctgtcattcaagctcaacggctattgtggtgacatttttatgtttttcattgccaagttgcatccatgtttgattttctgatgagactagagtgacagtgtttcagaacccaaatgtcctcaggtagtttggagcatctctatgagatgggattatgcagatggcctatggaaaatgcagctgcataattaacacattatcaaagtcctcttacaatttattttccgcagcatgtcagctaagtagacccaatggggagagaaaatgcctgctttctttccctctttttctgcactgccatattcacccccaaccatccaatctgtggataattggatgttagcggtactcttccacttccggtcctggagcttggcttgtatccaagtgtatggttgctttgcctaagaggaatccctctatttcacctgttctggaggcaccagaccttgaaaagaacatgctcaaaataaaatgttatctgttatttttgtaaactcaaagttaagatgatcaaagttctaaaattccaagaatgtgcttttagacggtctcaatctaaaagcacttcaaggggtcaaagggcaaccagcttggtgctacctcagtgttgtagtttctgatactttatgtctttgctcaccctcatccccaaactacttgaaaagggcatttggcaccactctctgaaacaacacagtcactctagcaaggcccccaaagggccctggttttacattacatttcaaactttatttgctttggggttttgtttctgttgttgttcaaatgcaaaaaaaagaaaaaaaaaagaaaaaaaaaggtgactcacattgttacacatgctttaaaatatgtgttcaaatgttattaaccacaatgacgacctgttttgatttaaccaagaagacggctgcggagcctagcagactcaggcctgtgggaatgggatttgttacaaatctaggtttgttactggcttcagaaagctaattaagtgctctgaaaaagacaccgtttcttgaaacaaagatggttgtattcctcactttgatgttgttttgcaagatgtttgtggaaatgttcatttgtatctggatctctgttatgtgccatttttcttctagcatcgaggtccttcattccttccacaactatttatccagcaccgtttctgggcacagggctccagcgatggtcccaacaggtacaatgacctctggggaccaagttcagttcttggtgagttctccagtgcctctcgatgtaggatgaaccgttggcatgctccactgacgctggctccttctgttgtttctcttggctccaggacccccgcagcaaacacaagtttaagatccacacgtactccagccccacgttttgtgaccactgtgggtcactgctgtatggactcatccaccaggggatgaaatgtgacagtaagtactttctctctctgggggcatctgctgatggcagaagcaatgggaagggctgcttccacttggtttggggtccaggtctgccatacattcccccctgtcctcgttggggctggtgtaccagttatctgttgctgcataatgatcctcccaccccaaaacactgtgactgaagacaataaacatttttttagctcatgactctgcaaggcagtcctttgaatctgggctggcctcagctgatgtcacgcatgttcataaagcatgaactcatggttcatggtggattagcagatggaggtgggctgggacatcaaggagacgagtcctggttggatagtaatgtctttaacacccctctagcatttattaatttcctctcttaacaaataaaagatgcccttcagtcagatgcttaggacagatgacgcacctagagatattttaataatgtagatactcttgctgttcaaactcagaccaaaatgacgataggcttttttggcccccagagggtgcacaaatacgaccagaatttgtgaagacgagtcagaaatgaatgaaatttggaaaaatattgatctactgaaatccttcctccccacactattagccctatgttacagttggggaaacggagtcgttttgcagaggggatggacagaaggtagggagttctcttccaaacgtgcaggaggcaagcaaagccaagaatcttctctgtggtgagttagagacatataaaataaagatcgctcctcccctacctctgcagaacgtgtgtgtgtatgtgtgtgtaagtgtgtgcggccacaagcctttccgaatgagtgacagcgggagcccatccctccaggagacgcgtgcagaatgaccaatgggatggatgggggtggatgggtaccagtctccgcagaggccggggtgggaattcgctgcgccccaccccttccacccgctccccttcgccccgtaggtctttccactctcgctcctcccctgggcacatctcctgaacgcagccccgggggccgaggacggggtggggtggggggcgaggctcgggtccgacgaccccgggctgcggtcccggcgctgcagagctgcggctgtgcacgcttagccgcgaggcccgcggtagcccgggcgccgatatgtaaagcagctggcagcgctgggcggggcctgggcgcgactgcaaatgaggagggcgcgggctggcccgggggctccgcctccctcccccgcagctggggccagcggctgccaagcgcactggtcgagcggcagcagctgggcgaggtgacagccccggctccgcgcgccggccgccagagccggcgcaggggaagcgcccgcggccccgggtgcagcagcggccgccgcctcccgcgcctccccggcccgcagcccgcggtcccgcgccccggggccggcacctctcgggctccggctccccgcgcgcaagatggctgacccggctgcggggccgccgccgagcgagggcgaggagagcaccgtgcgcttcgcccgcaaaggcgccctcaggcagaagaacgtgcatgaggtcaagaaccacaaattcaccgcccgcttcttcaagcagcccaccttctgcagccactgcaccgacttcatctggtgaccccccaggcactccggccccaggccacgccgcgccaggaccccctctccgcgccctctgcgccctccgcaccctggaccccgcgtccccggactccccgctccggaccctgctgcccgggactcccggatggacagtcctagccgttgccctgtccccaccctggtcccagacgggccgccgcgggcgcctcctgccctctcctgctctcaggcgcctctagagtcgactgcaggtcaacggacacatcaaggagagagtcctggttggatagtaatgtctttaacacccctctagcatttattaatttcctctcttaacaaataaaagatgacttcagttgaagatccttaggacagatgacggcacctggagatattttaataatgtagataccctcttgctgttcaaactcagaccaaaagagatggctttttttcccccagagggtgcacaaatacgacagaatttgtgaagacgagtcagaaatgaatgaaatttggaaaaatattgatctactgaaatccttcctccccacactattagccctatgttacagttggggaaacggagtcgttttgcagaggggatggacagaaggtagggagttctcttccaacgtgcaggaggcaagcaaagccaagcatcttctctgtggtggagttagagacatataaaataagatcgctcctcccctacctctgcagaacgtgtgtgtgtatgtgtgtgtaacgtgtgtgcggccacaagcctttccgaatgagtgacagcgggagcccatccctccaggagacgcgtgcagaatgaccaatgggatggatgggggtggatgggtaccgtctccgcgaggccggggtggaattcgctgcgccccaccccttccacccgctccccttcgccccgtaggtctttccactctcgctcctcccctgggcacatctcctgaacgcagccccgggggccgaggacggggtggggtggggggcgaggctcgggtccgacgaccccgggctgcggtcccggcgctgcagagctgcggctgtgcacgcttagccgcgaggcccgcggtagcccgggcgccgatatgtaaagcagctggcagcgctgggcggggcctgggcgcgatgcaaatgaggagggcggggctggcccggggctccgcctccctcccccgcagctggggccagcggtgccaagcgcagctggacgagcggcagcagctgggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgcttcgcccgcaaaggcgccctcaggcagaagaacgtgcatgaggtcaagaaccacaaattcaccgcccgcttcttcaagcagcccaccttctgcagccactgcaccgacttcatctggtggagcgcgcgcgcaaggcaccttcccgggcccccgaggcagcgccgcgccaagggaccccctctccgccctctgcgccctccgcaccctggaccccgcgtccccggactccccgctccggaccctgctgccgggactcccggatggacagtcctgccgttgccctgtccccaccctggtcccaggacgggggcgcctcctgccctctcctgctctcaggcgcctctagagcgcccaggggcagcgtcgcgggcgcctttgctccacctgactaggagcgcgcggggtctgtgcctgccctggagggcagcgcctcgggtgctctccgacccggggttccctatctctccgcctgcttccgggcgcgaggagccctcgccccccaccccttgtttccggggggggggggcggcgccctgggtgtccttctctatctctgcgggcatgggacatcctttctcactcctctgtgcctcggcagcgccctgtgttatctcccattgccctccccgagggcctggttcccctttccactcctcggtcacatcactgcgggcccctttcttccccagtccctccagtagtggggcatcctttcctccttcccagtccccctcccagaggacaccaccgccgcggggtcactctcgccctccctctgaatgcgtctttatctcttctcttttccgagggtgctcggggcatctatgggtacatctgtcgcctgccttcagcccctaccccgacggaaacgctccccactatcccgccacctggtggtcgcagcctcctctcttctgcaggagtgaaggcagatcggggttacagccgagctcccacctacccccacaaaggcggaagactcttgggcacccgcctgtggctgggagtttgcacctggggtacagaggcagggaggaaggcgggtgactctgtgggtaactagctggaggctgggcccccgggctgcctgacatacacctccttctgcttttgcaggggcttcgggaagcagggattccagtgccaaggtaggctctggggctttggggatgctatttgtgggaagagagggtgaaaaatactttatagaagaagttactgagttaggcagagagtgaaagaatcacgttggtcggagtgacctcccaggctaggaattcaaagcgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactttgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggagtgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcaggctagccctgccctccacccacacctgcccgctccccacgataagcaccagtgggactgtggtgacttctgctgctggccccgcccctgcccccagagcgtccttggctgccgtctggccgggctctcatggtacttcctctgtgaactgtgtgtgaatctgcttttcctctgccttcggagggaaattgtaaatcctgtgtttcattacttgaatgtagttatctattgaaaatatactttagagcacaatggatgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacaatctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgcttggagagctgaagggcagaggagagtactctgccatcaaggccctcaagaaggatgtggtcctgatcgacgacgacgtggagtgcaccatggttgagaagcgggtgctgacacttgccgcagagaatccctttctcacccacctcatctgcaccttccagaccaaggaccacctgttctttgtgatggagttcctcaacgggggggacctgatgtaccacatccaggacaaaggccgctttgaactctaccgtgccacgttttatgccgctgagataatgtgtggactgcagtttctacacagcaagggcatcatttacagggacctcaaactggacaatgtgctgttggaccgggatggccacatcaagattgccgactttgggatgtgcaaagagaacatattcggggagagccgggccagcaccttctgcggcacccctgactatatcgcccctgagatcctacagggcctgaagtacacattctctgtggactggtggtctttcggggtccttctgtacgagatgctcattggccagtcccccttccatggtgatgatgaggatgaactcttcgagtccatccgtgtggacacgccacattatccccgctggatcaccaaggagtccaaggacatcctggagaagctctttgaaagggaaccaaccaagaggctgggaatgacgggaaacatcaaaatccaccccttcttcaagaccataaactggactctgctggaaaagcggaggttggagccacccttcaggcccaaagtgaagtcacccagagactacagtaactttgaccaggagttcctgaacgagaaggcgcgcctctcctacagcgacaagaacctcatcgactccatggaccagtctgcattcgctggcttctcctttgtgaaccccaaattcgagcacctcctggaagattgaggttcctggacagatcccaagatggaagggagcggcggccgcgtccgcctcaaggcgcattacgggggggacatcttcatcaccagcgtggacgccgccacgaccttcgaggagctctgtgaggaagtgagagacatgtgtcgtctgcaccagcagcacccgctcaccctcaagtgggtggacagcgaaggtgacccttgcacggtgtcctcccagatggagctggaagaggctttccgcctggcccgtcagtgcagggatgaaggcctcatcattcatgttttcccgagcacccctgagcagcctggcctgccatgtccgggagaagacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggagctacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacgggcacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgaggccgcgtgcgtctctgtcgtggacacgcgtgattgaccctttaactgtatccttaaccaccgcatatgcatgccaggctgggcacggctccgagggcggccagggacagacgcttgcgccgagaccgcagagggaagcgtcagcgggcgctgctgggagcagaacagtccctcacacctggcccggcaggcagcttcgtgctggaggaacttgctgctgtgcctgcgtcgcggcggatccgcggggaccctgccgagggggctgtcatgcggtttccaaggtgcacattttccacggaaacagaactcgatgcactgacctgctccgccaggaaagtgagcgtgtagcgtcctgaggaataaaatgttccgatgaaaaaaaaaagggccggcggcggcggcgactctggacgcgagccgggcccttcccgtggatcgccccagctgcggcgggcgtcgcggccgcccccgggtggcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggagccccactgcaggccccaccatggcgccgttcctgcgcatcgccttcaactcctatgagctgggctccctgcaggccgaggacgaggcgaaccagcccttctgtgccgtgaagatgaaggaggcgctcagcacagagcgtgggaaaacactggtgcagaagaagccgaccatgtatcctgagtggaagtcgacgttcgatgcccacatctatgaggggcgcgtcatccagattgtgctaatgcgggcagcagaggagccagtgtctgaggtgaccgtgggtgtgtcggtgctggccgagcgctgcaagaagaacaatggcaaggctgagttctggctggacctgcagcctcaggccaaggtgttgatgtctgttcagtatttcctggaggacgtggattgcaaacagtctatgcgcagtgaggacgaggccaagttcccaacgatgaaccgccgcggagccatcaaacaggccaaaatccactacatcaagaaccatgagtttatcgccaccttctttgggcaacccaccttctgttctgtgtgcaaagactttgtctggggcctcaacaagcaaggctacaaatgcaggcaatgtaacgctgccatccacaagaaatgcatcgacaagatcatcggcagatgcactggcaccgcggccaacagccgggacactatattccagaaagaacgcttcaacatcgacatgccgcaccgcttcaaggttcacaactacatgagccccaccttctgtgaccactgcggcagcctgctctggggactggtgaagcagggattaaagtgtgaagactgcggcatgaatgtgcaccataaatgccgggagaaggtggccaacctctgcggcatcaaccagaagcttttggctgaggccttgaaccaagtcacccagagagcctcccggagatcagactcagcctcctcagagcctgttgggatatatcagggtttcgagaagaagaccggagttgctggggaggacatgcaagacaacagtgggacctacggcaagatctgggagggcagcagcaagtgcaacatcaacaacttcatcttccacaaggtcctgggcaaaggcagcttcgggaaggtgctgctctccccgccccgaccatggtagtgttcaatggccttcttaagatcaaaatctgcgaggccgtgagcttgaagcccacagcctggtcgctgcgccatgcggtgggaccccggccgcagactttccttctcgacccctacattgccctcaatgtggacgactcgcgcatcggccaaacggccaccaagcagaagaccaacagcccggcctggcacgacgagttcgtcaccgatgtgtgcaacggacgcaagatcgagctggctgtctttcacgatgcccccataggctacgacgacttcgtggccaactgcaccatccagtttgaggagctgctgcagaacgggagccgccacttcgaggactggattgatctggagccagaaggaagagtgtatgtgatcatcgatctctcagggtcgtcgggtgaagcccctaaagacaatgaagagcgtgtgttcagggaacgcatgcggccgaggaagcggcagggggccgtcaggcgcagggtccatcaggtcaacggccacaagttcatggccacctatcttcggcagcccacctactgctcccattgcagagacttcatctggggtgtcataggaaagcagggataccagtgtcaagtctgcacctgcgtggtccacaagcggtgccacgagctcataatcacaaagtgtgctgggttaaagaagcaggagacccccgaccaggtgggctcccagcggttcagcgtcaacatgccccacaagttcggtatccacaactacaaggtccctaccttctgcgatcactgtgggtccctgctctggggactcttgcggcagggtttgcagtgtaaagtctgcaaaatgaatgttcaccgtcgatgtgagaccaacgtggctcccaactgtggagtggatgccagaggaatcgccaaagtactggccgacctgggcgttaccccagacaaaatcaccaacagcggccagagaaggaaaaagctcattgctggtgccgagtccccgcagcctgcttctggaagctcaccatctgaggaagatcgatccaagtcagcacccacctccccttgtgaccaggaaataaaagaacttgagaacaacattcggaaagccttgtcatttgacaaccgaggagaggagcaccgggcagcatcgtctcctgatggccagctgatgagccccggtgagaatggcgaagtccggcaaggccaggccaagcgcctgggcctggatgagttcaacttcatcaaggtgttgggcaaaggcagctttggcaaggtcatgttggcagaactcaagggcaaagatgaagtatatgctgtgaaggtcttaaagaaggacgtcatccttcaggatgatgacgtggactgcacaatgacagagaagaggattttggctctggcacggaaacacccgtaccttacccaactctactgctgcttccagaccaaggaccgcctctttttcgtcatggaatatgtaaatggtggagacctcatgtttcagattcagcgctcccgaaaattcgacgagcctcgttcacggttctatgctgcagaggtcacatcggccctcatgttcctccatcagcatggagtcatctacagggatttgaaactggacaacatccttctggatgcagaaggtcactgcaagctggctgacttcgggatgtgcaaggaagggattctgaatggtgtgacgaccaccacgttctgtgggactcctgactacatagctcctgagatcctgcaggagttggagtatggcccctccgtggactggtgggccctgggggtgctgatgtacgagatgatggctggacagcctccctttgaggccgacaatgaggacgacctatttgagtccatcctccatgacgacgtgctgtacccagtctggctcagcaaggaggctgtcagcatcttgaaagctttcatgacgaagaatccccacaagcgcctgggctgtgtggcatcgcagaatggcgaggacgccatcaagcagcacccattcttcaaagagattgactgggtgctcctggagcagaagaagatcaagccacccttcaaaccacgcattaaaaccaaaagagacgtcaataattttgaccaagactttacccgggaagagccggtactcacccttgtggacgaagcaattgtaaagcagatcaaccaggaggaattcaaaggtttctcctactttggtgaagacctgatgccctgagagcccactgcagttagccggcttctggaaactccctgtgtgagtgtgagggaatgagtatgaacaaggcacattatgtcttacttattgtattagtttcctgttgctgctgtagcaagttaccaccaatttatggcttaaagcaattcaaattttttctcttgaattcttaagatcagaagttctaaatgagtctaatggggctaaaatcaaggtgttaggcaaaggcagcttgcagctggagatccgggctcccacagcagatgagatccacgtaactgttggcgaggcccgtaacctaattcctatggaccccaatggtctctctgatccctatgtgaaactgaagctcatcccagaccctcggaacctgacgaaacagaagacccgaacggtgaaagccacgctaaaccctgtgtggaatgagacctttgtgttcaacctgaagccaggggatgtggagcgccggctcagcgtggaggtgtgggactgggaccggacctcccgcaacgacttcatgggggccatgtcctttggcgtctcggagctgctcaaggcgcccgtggatggctggtacaagttactgaaccaggaggagggcgagtattacaatgtgccggtggccgatgctgacaactgcagcctcctccagaagtttgaggcttgtaactaccccctggaattgtatgagcgggtgcggatgggcccctcttcctctcccatcccctccccttcccctagtcccaccgaccccaagcgctgcttcttcggggcgagtccaggacgcctgcacatctccgacttcagcttcctcatggttctaggaaaaggcagttttgggaaggtgatgctggccgagcgcaggggctctgatgagctctacgccatcaagatcttgaaaaaggacgtgatcgtccaggacgacgatgtggactgcacgctggtggagaaacgtgtgctggcgctggggggccggggtcctggcggccggccccacttcctcacccagctccactccaccttccagaccccggaccgcctgtatttcgtgatggagtacgtcaccgggggagacttgatgtaccacattcaacagctgggcaagtttaaggagccccatgcagcgttctacgcggcagaaatcgctatcggcctcttcttccttcacaatcagggcatcatctacagggacctgaagctggacaatgtgatgctggatgctgagggacacatcaagatcactgactttggcatgtgtaaggagaacgtcttccccgggacgacaacccgcaccttctgcgggaccccggactacatagccccggagatcattgcctaccagccctatgggaagtctgtcgattggtggtcctttggagttctgctgtatgagatgttggcaggacagcctcccttcgatggggaggacgaggaggagctgtttcaggccatcatggaacaaactgtcacctaccccaagtcgctttcccgggaagccgtggccatctgcaaggggttcctgaccaagcacccagggaagcgcctgggctcagggcctgatggggaacctaccatccgtgcacatggctttttccgctggattgactgggagcggctggaacgattggagatcccgcctcctttcagaccccgcccgtgtggccgcagcggcgagaactttgacaagttcttcacgcgggcggcgccagcgctgacccctccagaccgcctagtcctggccagcatcgaccaggccgatttccagggcttcacctacgtgaaccccgacttcgtgcacccggatgcccgcagccccaccagcccagtgcctgtgcccgtcatgtaatctcacccgccgccactaggtgtccccaacgtcccctccgccgtgccggcggcagccccacttcacccccaacttcaccaccccctgtcccattctagatcctgcaccccagcattccagctctgcccccgcgggttctagacgcccctcccaagcgttcctggccttctgaactccatacagcctctacagccgtcccgcgttcaagacttgagcgcggggtgtcttgggcccgggcggctgtagaggcggcggcgcctacgggcagtgggaggagccgcgcggttccggctgctccggcgaggcgacccttgggtcggcgctgcgggcaggtggcaggtaggtggcggacggccgcggttctccggcaagcgcaggcggcggagtcccccacggcgcccgaagcgcccccccgcacccccggcctccagcgttgaggcgggggagtgaggagatgccgacccagagggacagcagcaccatgtcccacacggtcgcaggcggcggcagcggggaccattcccaccaggtccgggtgaaagcctactaccgcggggatatcatgataacacattttgaaccttccatctcctttgagggcctttgcaatgaggttcgagacatgtgttcttttgacaacgaacagctcttcaccatgaaatggatagatgaggaaggagacccgtgtacagtatcatctcagttggagttagaagaagcctttagactttatgagctaaacaaggattctgaactcttgattcatgtgttcccttgtgtaccagaacgtcctgggatgccttgtccaggagaagataaatccatctaccgtagaggtgcacgccgctggagaaagctttattgtgccaatggccacactttccaagccaagcgtttcaacaggcgtgctcactgtgccatctgcacagaccgaatatggggacttggacgccaaggatataagtgcatcaactgcaaactcttggttcataagaagtgccataaactcgtcacaattgaatgtgggcggcattctttgccacaggaaccagtgatgcccatggatcagtcatccatgcattctgaccatgcacagacagtaattccatataatccttcaagtcatgagagtttggatcaagttggtgaagaaaaagaggcaatgaacaccagggaaagtggcaaagcttcatccagtctaggtcttcaggattttgatttgctccgggtaataggaagaggaagttatgccaaagtactgttggttcgattaaaaaaaacagatcgtatttatgcaatgaaagttgtgaaaaaagagcttgttaatgatgatgaggatattgattgggtacagacagagaagcatgtgtttgagcaggcatccaatcatcctttccttgttgggctgcattcttgctttcagacagaaagcagattgttctttgttatagagtatgtaaatggaggagacctaatgtttcatatgcagcgacaaagaaaacttcctgaagaacatgccagattttactctgcagaaatcagtctagcattaaattatcttcatgagcgagggataatttatagagatttgaaactggacaatgtattactggactctgaaggccacattaaactcactgactacggcatgtgtaaggaaggattacggccaggagatacaaccagcactttctgtggtactcctaattacattgctcctgaaattttaagaggagaagattatggtttcagtgttgactggtgggctcttggagtgctcatgtttgagatgatggcaggaaggtctccatttgatattgttgggagctccgataaccctgaccagaacacagaggattatctcttccaagttattttggaaaaacaaattcgcataccacgttctctgtctgtaaaagctgcaagtgttctgaagagttttcttaataaggaccctaaggaacgattgggttgtcatcctcaaacaggatttgctgatattcagggacacccgttcttccgaaatgttgattgggatatgatggagcaaaaacaggtggtacctccctttaaaccaaatatttctggggaatttggtttggacaactttgattctcagtttactaatgaacctgtccagctcactccagatgacgatgacattgtgaggaagattgatcagtctgaatttgaaggttttgagtatatcaatcctcttttgatgtctgcagaagaatgtgtctgatcctcatttttcaaccatgtattctactcatgttgccatttaatgcatggataaacttgctgcaagcctggatacaattaaccattttatatttgccacctacaaaaaaacacccaatatcttctcttgtagactatatgaatcaattattacatctcgacccggaatgaattcggacggaggaggcagaatggccagtcgaggggcgcttaggcgtggcctttccccagggctgcctcgactcctgcacctgtcccgagggctggcctgagacgggactcccggttctcccgctgcgaagcaggccccccggggccggggcagcggcgccggcatgtcgtctggcaccatgaagttcaatggctatttgagggtccgcatcggtgaggcagtggggctgcagcccacccgctggtccctgcgccactcgctcttcaagaagggccaccagctgctggacccctatctgacggtgagcgtggaccaggtgcgcgtgggccagaccagcaccaagcagaagaccaacaaacccacgtacaacgaggagttttgcgctaacgtcaccgacggcggccacctcgagttggccgtcttccacgagacccccctgggctacgacttcgtggccaactgcaccctgcagttccaggagctcgtcggcacgaccggcgcctcggacaccttcgagggttgggtggatctcgagccagaggggaaagtatttgtggtaataacccttaccgggagtttcactgaagctactctccagagagaccggatcttcaaacattttaccaggaagcgccaaagggctatgcgaaggcgagtccaccagatcaatggacacaagttcatggccacgtatctgaggcagcccacctactgctctcactgcagggagtttatctggggagtgtttgggaaacagggttatcagtgccaagtgtgcacctgtgtcgtccataaacgctgccatcatctaattgttacagcctgtacttgccaaaacaatattaacaaagtggattcaaagattgcagaacagaggttcgggatcaacatcccacacaagttcagcatccacaactacaaagtgccaacattctgcgatcactgtggctcactgctctggggaataatgcgacaaggacttcagtgtaaaatatgtaaaatgaatgtgcatattcgatgtcaagcgaacgtggcccctaactgtggggtaaatgcggtggaacttgccaagaccctggcagggatgggtctccaacccggaaatatttctccaacctcgaaactcgtttccagatcgaccctaagacgacagggaaaggagagcagcaaagaaggaaatgggattggggttaattcttccaaccgacttggtatcgacaactttgagttcatccgagtgttggggaaggggagttttgggaaggtgatgcttgcaagagtaaaagaaacaggagacctctatgctgtgaaggtgctgaagaaggacgtgattctgctggatgatgatgtggaatgcaccatgaccgagaaaaggatcctgtctctggcccgcaatcaccccttcctcactcagttgttctgctgctttcagacccccgatcgtctgttttttgtgatggagtttgtgaatgggggtgacttgatgttccacattcagaagtctcgtcgttttgatgaagcacgagctcgcttctatgctgcagaaatcatttcggctctcatgttcctccatgataaaggaatcatctatagagatctgaaactggacaatgtcctgttggaccacgagggtcactgtaaactggcagacttcggaatgtgcaaggaggggatttgcaatggtgtcaccacggccacattctgtggcacgccagactatatcgctccagagatcctccaggaaatgctgtacgggcctgcagtagactggtgggcaatgggcgtgttgctctatgagatgctctgtggtcacgcgccttttgaggcagagaatgaagatgacctctttgaggccatactgaatgatgaggtggtctaccctacctggctccatgaagatgccacagggatcctaaaatctttcatgaccaagaaccccaccatgcgcttgggcagcctgactcagggaggcgagcacgccatcttgagacatcctttttttaaggaaatcgactgggcccagctgaaccatcgccaaatagaaccgcctttcagacccagaatcaaatcccgagaagatgtcagtaattttgaccctgacttcataaaggaagagccagttttaactccaattgatgagggacatcttccaatgattaaccaggatgagtttagaaacttttcctatgtgtctccagaattgcaaccatagccttatggggagtgagagagagggcacgagaacccaaaggaatagagattctccaggaatttcctctatcggaccttcccagcatcagccttagaacaagaaccttaccttcaaggagcaagtgaagaactctgtcgaaggatggaactttcagatatcaactatttagagtccgaattccttctctcctcctcctcgcccttctcctcgccctcctcctcctcctcgccctcccctcccgatcctcatccccttgccctcccccagcccagggacttttccggaaagtttttattttccgtctgggctctcggagaaagaagctcctggctcagcggctgcaaaactttcctgctgccgcgccgccagcccccgccctccgctgcccggccctgcgccccgccgagcgatgagcgcccctccggtcctgcggccgcccagtccgctgctgcccgtggcggcggcagctgccgcagcggccgccgcactggtcccagggtccgggcccgggcccgcgccgttcttggctcctgtcgcggccccggtcgggggcatctcgttccatctgcagatcggcctgagccgtgagccggtgctgctgctgcaggactcgtccggggactacagcctggcgcacgtccgcgagatggcttgctccattgtcgaccagaagttccctgaatgtggtttctacggaatgtatgataagatcctgctttttcgccatgaccctacctctgaaaacatccttcagctggtgaaagcggccagtgatatccaggaaggcgatcttattgaagtggtcttgtcacgttccgccacctttgaagactttcagattcgtccccacgctctctttgttcattcatacagagctccagctttctgtgatcactgtggagaaatgctgtgggggctggtacgtcaaggtcttaaatgtgaagggtgtggtctgaattaccataagagatgtgcatttaaaatacccaacaattgcagcggtgtgaggcggagaaggctctcaaacgtttccctcactggggtcagcaccatccgcacatcatctgctgaactctctacaagtgcccctgatgagccccttctgcaaaaatcaccatcagagtcgtttattggtcgagagaagaggtcaaattctcaatcatacattggacgaccaattcaccttgacaagattttgatgtctaaagttaaagtgccgcacacatttgtcatccactcctacacccggcccacagtgtgccagtactgcaagaagcttctgaaggggcttttcaggcagggcttgcagtgcaaagattgcagattcaactgccataaacgttgtgcaccgaaagtaccaaacaactgccttggcgaagtgaccattaatggagatttgcttagccctggggcagagtctgatgtggtcatggaagaagggagtgatgacaatgatagtgaaaggaacagtgggctcatggatgatatggaagaagcaatggtccaagatgcagagatggcaatggcagagtgccagaacgacagtggcgagatgcaagatccagacccagaccacgaggacgccaacagaaccatcagtccatcaacaagcaacaatatcccactcatgagggtagtgcagtctgtcaaacacacgaagaggaaaagcagcacagtcatgaaagaaggatggatggtccactacaccagcaaggacacgctgcggaaacggcactattggagattggatagcaaatgtattaccctctttcagaatgacacaggaagcaggtactacaaggaaattcctttatctgaaattttgtctctggaaccagtaaaaacttcagctttaattcctaatggggccaatcctcattgtttcgaaatcactacggcaaatgtagtgtattatgtgggagaaaatgtggtcaatccttccagcccatcaccaaataacagtgttctcaccagtggcgttggtgcagatgtggccaggatgtgggagatagccatccagcatgcccttatgcccgtcattcccaagggctcctccgtgggtacaggaaccaacttgcacagagatatctctgtgagtatttcagtatcaaattgccagattcaagaaaatgtggacatcagcacagtatatcagatttttcctgatgaagtactgggttctggacagtttggaattgtttatggaggaaaacatcgtaaaacaggaagagatgtagctattaaaatcattgacaaattacgatttccaacaaaacaagaaagccagcttcgtaatgaggttgcaattctacagaaccttcatcaccctggtgttgtaaatttggagtgtatgtttgagacgcctgaaagagtgtttgttgttatggaaaaactccatggagacatgctggaaatgatcttgtcaagtgaaaagggcaggttgccagagcacataacgaagtttttaattactcagatactcgtggctttgcggcaccttcattttaaaaatatcgttcactgtgacctcaaaccagaaaatgtgttgctagcctcagctgatccttttcctcaggtgaaactttgtgattttggttttgcccggatcattggagagaagtctttccggaggtcagtggtgggtacccccgcttacctggctcctgaggtcctaaggaacaagggctacaatcgctctctagacatgtggtctgttggggtcatcatctatgtaagcctaagcggcacattcccatttaatgaagatgaagacatacacgaccaaattcagaatgcagctttcatgtatccaccaaatccctggaaggaaatatctcatgaagccattgatcttatcaacaatttgctgcaagtaaaaatgagaaagcgctacagtgtggataagaccttgagccacccttggctacaggactatcagacctggttagatttgcgagagctggaatgcaaaatcggggagcgctacatcacccatgaaagtgatgacctgaggtgggagaagtatgcaggcgagcagcggctgcagtaccccacacacctgatcaatccaagtgctagccacagtgacactcctgagactgaagaaacagaaatgaaagccctcggtgagcgtgtcagcatcctctgagttccatctcctataatctgtcaaaacactgtggaactaataaatacatacggtcaggtttaacatttgccttgcagaactgccattattttctgtcagatgagaacaaagctgttaaactgttagcactgttgatgtatctgagttgccaagacaaatcaacagaagcatttgtattttgtgtgaccaactgtgttgtattaacaaaagttccctgaaacacgaaacttgttattgtgaatgattcatgttatatttaatgcattaaacctgtctccactgtgcctttgcaaatcagtgtttttcttactggagcttcattttggtaagagacagaatgtatctgtgaagtagttctgtttggtgtgtcccattggtgttgtcattgtaaacaaactcttgaagagtcgattatttccagtgttctatgaacaactccaaaacccatgtgggaaaaaaatgaatgaggagggtagggaataaaatcctaagacacaaatgcatgaacaagttttaatgtatagttttgaatcctttgcctgcctggtgtgcctcagtatatttaaactcaagacaatgcacctagctgtgcaagacctagtgctcttaagcctaaatgccttagaaatgtaaactgccatatataacagatacatttccctctttcttataatactctgttgtactatggaaaatcagctgctcagcaacctttcacctttgtgtatttttcaataataaaaaatattcttgtcaaaaaaaaaaaaatgctcgctccagggcgcaaccatgtcgccatttcttcggattggcttgtccaactttgactgcgggtcctgccagtcttgtcagggcgaggctgttaacccttactgtgctgtgctcgtcaaagagtatgtcgaatcagagaacgggcagatgtatatccagaaaaagcctaccatgtacccaccctgggacagcacttttgatgcccatatcaacaagggaagagtcatgcagatcattgtgaaaggcaaaaacgtggacctcatctctgaaaccaccgtggagctctactcgctggctgagaggtgcaggaagaacaacgggaagacagaaatatggttagagctgaaacctcaaggccgaatgctaatgaatgcaagatactttctggaaatgagtgacacaaaggacatgaatgaatttgagacggaaggcttctttgctttgcatcagcgccggggtgccatcaagcaggcaaaggtccaccacgtcaagtgccacgagttcactgccaccttcttcccacagcccacattttgctctgtctgccacgagtttgtctggggcctgaacaaacagggctaccagtgccgacaatgcaatgcagcaattcacaagaagtgtattgataaagttatagcaaagtgcacaggatcagctatcaatagccgagaaaccatgttccacaaggagagattcaaaattgacatgccacacagatttaaagtctacaattacaagagcccgaccttctgtgaacactgtgggaccctgctgtggggactggcacggcaaggactcaagtgtgatgcatgtggcatgaatgtgcatcatagatgccagacaaaggtggccaacctttgtggcataaaccagaagctaatggctgaagcgctggccatgattgagagcactcaacaggctcgctgcttaagagatactgaacagatcttcagagaaggtccggttgaaattggtctcccatgctccatcaaaaatgaagcaaggccgccatgtttaccgacaccgggaaaaagagagcctcagggcatttcctgggagtctccgttggatgaggtggataaaatgtgccatcttccagaacctgaactgaacaaagaaagaccatctctgcagattaaactaaaaattgaggattttatcttgcacaaaatgttggggaaaggaagttttggcaaggtcttcctggcagaattcaagaaaaccaatcaatttttcgcaataaaggccttaaagaaagatgtggtcttgatggacgatgatgttgagtgcacgatggtagagaagagagttctttccttggcctgggagcatccgtttctgacgcacatgttttgtacattccagaccaaggaaaacctcttttttgtgatggagtacctcaacggaggggacttaatgtaccacatccaaagctgccacaagttcgacctttccagagcgacgttttatgctgctgaaatcattcttggtctgcagttccttcattccaaaggaatagtctacagggacctgaagctagataacatcctgttagacaaagatggacatatcaagatcgcggattttggaatgtgcaaggagaacatgttaggagatgccaagacgaataccttctgtgggacacctgactacatcgccccagagatcttgctgggtcagaaatacaaccactctgtggactggtggtccttcggggttctcctttatgaaatgctgattggtcagtcgcctttccacgggcaggatgaggaggagctcttccactccatccgcatggacaatcccttttacccacggtggctggagaaggaagcaaaggaccttctggtgaagctcttcgtgcgagaacctgagaagaggctgggcgtgaggggagacatccgccagcaccctttgtttcgggagatcaactgggaggaacttgaacggaaggagattgacccaccgttccggccgaaagtgaaatcaccatttgactgcagcaatttcgacaaagaattcttaaacgagaagccccggctgtcatttgccgacagagcactgatcaacagcatggaccagaatatgttcaggaacttttccttcatgaaccccgggatggagcggctgatatcctgaatcttgcccctccagagacaggaaagaatttgccttctccctgggaactggttcaagagacactgcttgggttcctttttcaacttggaaaaagaaagaaacactcaacaataaagactgagacccgttcgcccccatgtgactttatctgtagcagaaaccaagtctacttcactaatgacgatgccgtgtgtctcgtctcctgacatgtctcacagacgctcctgaagttaggtcattactaaccatagttatttacttgaaagatgggtctccgcacttggaaaggtttcaagacttgatactgcaataaattatggctcttcacctgggcgccaactgctgatcaacgaaatgcttgttgaatcaggggcaaacggagtacagacgtctcaagactgaaacggccccattgcctggtctagtagcggatctcactcagccgcagacaagtaatcactaacccgttttattctatcctatctgtggatgtataaatgctgggggccagccctggataggtttttatgggaattctttacaataaacatagcttgtacttgatgcccagcaggaccgaccccaagatggaagggagcggcggccgcgtccgcctcaaggcgcattacgggggggacatcttcatcaccagcgtggacgccgccacgaccttcgaggagctctgtgaggaagtgagagacatgtgtcgtctgcaccagcagcacccgctcaccctcaagtgggtggacagcgaaggtgacccttgcacggtgtcctcccagatggagctggaagaggctttccgcctggcccgtcagtgcagggatgaaggcctcatcattcatgttttcccgagcacccctgagcagcctggcctgccatgtccgggagaagacaaatctatctaccgccggggagccagaagatggaggaagctgtaccgtgccaacggccacctcttccaagccaagcgctttaacaggagagcgtactgcggtcagtgcagcgagaggatatggggcctcgcgaggcaaggctacaggtgcatcaactgcaaactgctggtccataagcgctgccacggcctcgtcccgctgacctgcaggaagcatatggattctgtcatgccttcccaagagcctccagtagacgacaagaacgaggacgccgaccttccttccgaggagacagatggaattgcttacatttcctcatcccggaagcatgacagcattaaagacgactcggaggaccttaagccagttatcgatgggatggatggaatcaaaatctctcaggggcttgggctgcaggactttgacctaatcagagtcatcgggcgcgggacgtacgccaaggttctcctggtgcggttgaagaagaatgaccaaatttacgccatgaaagtggtgaagaaagagctggtgcatgatgacgaggatattgactgggtacagacagagaagcacgtgtttgagcaggcatccagcaaccccttcctggtcggattacactcctgcttccagacgacaagtcggttgttcctggtcattgagtacgtcaacggcggggacctgatgttccacatgcagaggcagaggaagctccctgaggagcacgccaggttctacgcggccgagatctgcatcgccctcaacttcctgcacgagagggggatcatctacagggacctgaagctggacaacgtcctcctggatgcggacggacacatcaagctcacagactacggcatgtgcaaggaaggcctgggccctggtgacacaacgagcactttctgcggaaccccgaattacatcgcccccgaaatcctgcggggagaggagtacgggttcagcgtggactggtgggcgctgggagtcctcatgtttgagatgatggccgggcgctccccgttcgacatcatcaccgacaacccggacatgaacacagaggactaccttttccaagtgatcctggagaagcccatccggatcccccggttcctgtccgtcaaagcctcccatgttttaaaaggatttttaaataaggaccccaaagagaggctcggctgccggccacagactggattttctgacatcaagtcccacgcgttcttccgcagcatagactgggacttgctggagaagaagcaggcgctccctccattccagccacagatcacagacgactacggtctggacaactttgacacacagttcaccagcgagcccgtgcagctgaccccagacgatgaggatgccataaagaggatcgaccagtcagagttcgaaggctttgagtatatcaacccattattgctgtccaccgaggagtcggtgtgatgtcatgccttcccaagagcctccaggatggctgtcctccgacctcctccacctccaggctctagatggcaaagcccacttagcaaaagccacctgctctgtgatgatgggactggctcctgcctgtgggttcggaaagcccatcccaccctctacagcctcttgctcctctgcaatgactgtgccttcacctgggggttccccagagactagtgagagtcatcgggcgtggaagctat

SEQ ID NO: 2992 - DNA, 1649 bp; single-stranded, linear
gccacttcttctgggcccacgaggcagctgtcccatgctctgctgagcacggtggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccaatccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaagg

SEQ ID NO: 2993 - DNA, 703 bp; single-stranded, linear
ccaccaatcttgggcaagaagcgagaccattctcctttttctctggtcactcctgtccttcagggggctccctctggccccgactgtccattgctgctgaagtaatgctgtggcctttctcagtttgggccccacccaaaaccgaagaacttctccccagaagcttctacttggttctcagtgttttcacagttatgggaacccaagaacagtgtcagacctaggaggtgccccactaccaccctgtctttatcaatgttgtcaccaaagctgtcacaaacaatggggtgtgggctgtcacatggccctgcctaagtaaccacattctcgcttcctccttccacacacagccattgggggttgctcggatccgggactgccgcagggggtgccacagcagtgcctggcagcgtgggctgggaccttgtcactaaagcagagaagccacttcttctgggcccacgaggcagctgtcccatgctctgctgagcacggtggtaagtgctggcttgcaaaaccacagggagtggctggaggtccccatgggccaagggcctgccttatagctgctggcaggcccgggtaggaccgccaggcccttcttgagctgcagcacctggggagggcaaactgaggctcctccgactcaagactaaagtcttcctggagtctgtggccttattctgtgactcttctgaatcct

SEQ ID NO: 2994 - DNA, 3409 bp; single-stranded, linear
tagaagaagttaaagggccctcctggatggctttattcatgttgatgagtaataataataactgctactggctgaggatcttctccatcccaggcatgtcagggatgcctaagtccccagtccctgctccagaccagacatcttccagctgtggcagtagagggtggtggtctagggtgcttgctaagcccaagggtgaaactgtcttgacatccctccgcccattgtctcctcctaggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactcaaccagtgcccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccaatccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaaggaagatggagctcccccatcccacacgcactgcactgccattgtcttttggttgccatggtcaccaaacaggaagtggacattctaagggaggagtactgaagagtgacggacttctgaggctgtttcctgctgctcctctgacttggggcagcttgggtcttcttgggcacctctctgggaaaacccagggtgaggttcagcctgtgagggctgggatgggtttcgtgggcccaaagggcagacctttctttgggactgtgtggaccaaggagcttccatctagtgacaagtgacccccagctatcgcctcttgccttcccctgtggccactttccagggtggactctgtcttgttcactgcagtatcccaactgcaggtccagtgcaggcaataaatatgtgatggacaaaacgatagcggaatccttcaaggtttcaaggctgtctccttcaggcagccttcccggaattctccatccctcagtgcaggatgggggctggtcctcagctgtctgccctcagcccctggccccccaggaagcctctttcatgggctgttaggttgacttcagttttgcctcttggacaacagggggtcttgtacatccttgggtgaccaggaaaagttcaggctatggggggccaaagggagggctgccccttccccaccagtgaccactttattccacttcctccattacccagttttggcccacagagtttggtcccccccaaacctcggaccaatatccctctaaacatcaatctatcctcctgttaaagaaaaaaaaaaatgggactgggagcagtggctcatgcctgtaatcccagcactttgggaggccgaggcaggtacatcacctgaggtcaggagttcaagactagcctggccaacatagtgaaaccctgtctctactaaaaatacaaagattagtcaggtgtggtggcacatgcctgtagtcccagctactggggaggctgaggcaggagaattgcttgaacccgggaagcggagggaggttgcagtgagctgagatcacgctactgcactccagcctgggtgacagagtaagactccgtctcaaaaaaaaaaaaaaagattcaatgacccttgttaaagcatggtaaggaagactttgttcaaggggagtgggactctctcaatcactgcagggactgcagctatgggattttgcagtgggggcatttgggctcaactatgagtacagcaggggcaagtgggagctgatagccagggaacagggttggatatctgcagctggaaaattaccaagaggaaacatcaggggaaggggaattctggctaaactgactgctggggatgggttctcggtcattttctacactgacctaacaggattcatactggaggcaggccagggtgctcagacatcaccggggggatggtggcagatgaggaacgtgatcagatataggaggtgatcagatatgggaggtgatcagatatggagtggtggggggagggttgttgctaagctgacttagcagagttcttgttagaac

SEQ ID NO: 2995 - DNA, 3409 bp; single-stranded, linear; identical to SEQ ID NO: 2994

SEQ ID NO: 2996 - DNA, 9170 bp; single-stranded, linear
gccacttcttctgggcccacgaggcagctgtcccatgctctgctgagcacggtggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccaatccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaaggccaccaatcttgggcaagaagcgagaccattctcctttttctctggtcactcctgtccttcagggggctccctctggccccgactgtccattgctgctgaagtaatgctgtggcctttctcagtttgggccccacccaaaaccgaagaacttctccccagaagcttctacttggttctcagtgttttcacagttatgggaacccaagaacagtgtcagacctaggaggtgccccactaccaccctgtctttatcaatgttgtcaccaaagctgtcacaaacaatggggtgtgggctgtcacatggccctgcctaagtaaccacattctcgcttcctccttccacacacagccattgggggttgctcggatccgggactgccgcagggggtgccacagcagtgcctggcagcgtgggctgggaccttgtcactaaagcagagaagccacttcttctgggcccacgaggcagctgtcccatgctctgctgagcacggtggtaagtgctggcttgcaaaaccacagggagtggctggaggtccccatgggccaagggcctgccttatagctgctggcaggcccgggtaggaccgccaggcccttcttgagctgcagcacctggggagggcaaactgaggctcctccgactcaagactaaagtcttcctggagtctgtggccttattctgtgactcttctgaatccttagaagaagttaaagggccctcctggatggctttattcatgttgatgagtaataataataactgctactggctgaggatcttctccatcccaggcatgtcagggatgcctaagtccccagtccctgctccagaccagacatcttccagctgtggcagtagagggtggtggtctagggtgcttgctaagcccaagggtgaaactgtcttgacatccctccgcccattgtctcctcctaggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactcaaccagtgcccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccaatccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaaggaagatggagctcccccatcccacacgcactgcactgccattgtcttttggttgccatggtcaccaaacaggaagtggacattctaagggaggagtactgaagagtgacggacttctgaggctgtttcctgctgctcctctgacttggggcagcttgggtcttcttgggcacctctctgggaaaacccagggtgaggttcagcctgtgagggctgggatgggtttcgtgggcccaaagggcagacctttctttgggactgtgtggaccaaggagcttccatctagtgacaagtgacccccagctatcgcctcttgccttcccctgtggccactttccagggtggactctgtcttgttcactgcagtatcccaactgcaggtccagtgcaggcaataaatatgtgatggacaaaacgatagcggaatccttcaaggtttcaaggctgtctccttcaggcagccttcccggaattctccatccctcagtgcaggatgggggctggtcctcagctgtctgccctcagcccctggccccccaggaagcctctttcatgggctgttaggttgacttcagttttgcctcttggacaacagggggtcttgtacatccttgggtgaccaggaaaagttcaggctatggggggccaaagggagggctgccccttccccaccagtgaccactttattccacttcctccattacccagttttggcccacagagtttggtcccccccaaacctcggaccaatatccctctaaacatcaatctatcctcctgttaaagaaaaaaaaaaatgggactgggagcagtggctcatgcctgtaatcccagcactttgggaggccgaggcaggtacatcacctgaggtcaggagttcaagactagcctggccaacatagtgaaaccctgtctctactaaaaatacaaagattagtcaggtgtggtggcacatgcctgtagtcccagctactggggaggctgaggcaggagaattgcttgaacccgggaagcggagggaggttgcagtgagctgagatcacgctactgcactccagcctgggtgacagagtaagactccgtctcaaaaaaaaaaaaaaagattcaatgacccttgttaaagcatggtaaggaagactttgttcaaggggagtgggactctctcaatcactgcagggactgcagctatgggattttgcagtgggggcatttgggctcaactatgagtacagcaggggcaagtgggagctgatagccagggaacagggttggatatctgcagctggaaaattaccaagaggaaacatcaggggaaggggaattctggctaaactgactgctggggatgggttctcggtcattttctacactgacctaacaggattcatactggaggcaggccagggtgctcagacatcaccggggggatggtggcagatgaggaacgtgatcagatataggaggtgatcagatatgggaggtgatcagatatggagtggtggggggagggttgttgctaagctgacttagcagagttcttgttagaactagaagaagttaaagggccctcctggatggctttattcatgttgatgagtaataataataactgctactggctgaggatcttctccatcccaggcatgtcagggatgcctaagtccccagtccctgctccagaccagacatcttccagctgtggcagtagagggtggtggtctagggtgcttgctaagcccaagggtgaaactgtcttgacatccctccgcccattgtctcctcctaggtgccatgcctctgcaactcctcctgttgctgatcctactgggccctggcaacagcttgcagctgtgggacacctgggcagatgaagccgagaaagccttgggtcccctgcttgcccgggaccggagacaggccaccgaatatgagtacctagattatgatttcctgccagaaacggagcctccagaaatgctgaggaacagcactgacaccactcctctgactgggcctggaacccctgagtctaccactgtggagcctgctgcaaggcgttctactggcctggatgcaggaggggcagtcacagagctgaccacggagctggccaacatggggaacctgtccacggattcagcagctatggagatacagaccactcaaccagcagccacggaggcacagaccactcaaccagtgcccacggaggcacagaccactccactggcagccacagaggcacagacaactcgactgacggccacggaggcacagaccactccactggcagccacagaggcacagaccactccaccagcagccacggaagcacagaccactcaacccacaggcctggaggcacagaccactgcaccagcagccatggaggcacagaccactgcaccagcagccatggaagcacagaccactccaccagcagccatggaggcacagaccactcaaaccacagccatggaggcacagaccactgcaccagaagccacggaggcacagaccactcaacccacagccacggaggcacagaccactccactggcagccatggaggccctgtccacagaacccagtgccacagaggccctgtccatggaacctactaccaaaagaggtctgttcatacccttttctgtgtcctctgttactcacaagggcattcccatggcagccagcaatttgtccgtcaactacccagtgggggccccagaccacatctctgtgaagcagtgcctgctggccatcctaatcttggcgctggtggccactatcttcttcgtgtgcactgtggtgctggcggtccgcctctcccgcaagggccacatgtaccccgtgcgtaattactcccccaccgagatggtctgcatctcatccctgttgcctgatgggggtgaggggccctctgccacagccaatgggggcctgtccaaggccaagagcccgggcctgacgccagagcccagggaggaccgtgagggggatgacctcaccctgcacagcttcctcccttagctcactctgccatctgttttggcaagaccccacctccacgggctctcctgggccacccctgagtgcccagaccccaatccacagctctgggcttcctcggagacccctggggatggggatcttcagggaaggaactctggccacccaaacaggacaagagcagcctggggccaagcagacgggcaagtggagccacctctttcctccctccgcggatgaagcccagccacatttcagccgaggtccaaggcaggaggccatttacttgagacagattctctcctttttcctgtcccccatcttctctgggtccctctaacatctcccatggctctccccgcttctcctggtcactggagtctcctccccatgtacccaaggaagatggagctcccccatcccacacgcactgcactgccattgtcttttggttgccatggtcaccaaacaggaagtggacattctaagggaggagtactgaagagtgacggacttctgaggctgtttcctgctgctcctctgacttggggcagcttgggtcttcttgggcacctctctgggaaaacccagggtgaggttcagcctgtgagggctgggatgggtttcgtgggcccaaagggcagacctttctttgggactgtgtggaccaaggagcttccatctagtgacaagtgacccccagctatcgcctcttgccttcccctgtggccactttccagggtggactctgtcttgttcactgcagtatcccaactgcaggtccagtgcaggcaataaatatgtgatggacaaaacgatagcggaatccttcaaggtttcaaggctgtctccttcaggcagccttcccggaattctccatccctcagtgcaggatgggggctggtcctcagctgtctgccctcagcccctggccccccaggaagcctctttcatgggctgttaggttgacttcagttttgcctcttggacaacagggggtcttgtacatccttgggtgaccaggaaaagttcaggctatggggggccaaagggagggctgccccttccccaccagtgaccactttattccacttcctccattacccagttttggcccacagagtttggtcccccccaaacctcggaccaatatccctctaaacatcaatctatcctcctgttaaagaaaaaaaaaaatgggactgggagcagtggctcatgcctgtaatcccagcactttgggaggccgaggcaggtacatcacctgaggtcaggagttcaagactagcctggccaacatagtgaaaccctgtctctactaaaaatacaaagattagtcaggtgtggtggcacatgcctgtagtcccagctactggggaggctgaggcaggagaattgcttgaacccgggaagcggagggaggttgcagtgagctgagatcacgctactgcactccagcctgggtgacagagtaagactccgtctcaaaaaaaaaaaaaaagattcaatgacccttgttaaagcatggtaaggaagactttgttcaaggggagtgggactctctcaatcactgcagggactgcagctatgggattttgcagtgggggcatttgggctcaactatgagtacagcaggggcaagtgggagctgatagccagggaacagggttggatatctgcagctggaaaattaccaagaggaaacatcaggggaaggggaattctggctaaactgactgctggggatgggttctcggtcattttctacactgacctaacaggattcatactggaggcaggccagggtgctcagacatcaccggggggatggtggcagatgaggaacgtgatcagatataggaggtgatcagatatgggaggtgatcagatatggagtggtggggggagggttgttgctaagctgacttagcagagttcttgttagaac

SEQ ID NO: 2997 - DNA, 1830 bp; single-stranded, linear
cctgcctgcacggcacaggagagcaaacttctacagacagaccaaggcttccatttgctgctgacacatggaactgaggtgaaattgtgctccatgattttacagatttcataacgtttaagagacgggactcaggtcatcaaaatgaaagccctcatctttgcagctgctggcctcctgcttctgttgcccactttttgtcagagtggcatggaaaatgatacaaacaacttggcaaagccaaccttacccattaagacctttcgtggagctcccccaaattcttttgaagagttccccttttctgccttggaaggctggacaggagccacgattactgtaaaaattaagtgccctgaagaaagtgcttcacatctccatgtgaaaaatgctaccatggggtacctgaccagctccttaagtactaaactgatacctgccatctacctcctggtgtttgtagttggtgtcccggccaatgctgtgaccctgtggatgcttttcttcaggaccagatccatctgtaccactgtattctacaccaacctggccattgcagattttcttttttgtgttacattgccctttaagatagcttatcatctcaatgggaacaactgggtatttggagaggtcctgtgccgggccaccacagtcatcttctatggcaacatgtactgctccattctgctccttgcctgcatcagcatcaaccgctacctggccatcgtccatcctttcacctaccggggcctgcccaagcacacctatgccttggtaacatgtggactggtgtgggcaacagttttcttatatatgctgccatttttcatactgaagcaggaatattatcttgttcagccagacatcaccacctgccatgatgttcacaacacttgcgagtcctcatctcccttccaactctattacttcatctccttggcattctttggattcttaattccatttgtgcttatcatctactgctatgcagccatcatccggacacttaatgcatacgatcatagatggttgtggtatgttaaggcgagtctcctcatccttgtgatttttaccatttgctttgctccaagcaatattattcttattattcaccatgctaactactactacaacaacactgatggcttatattttatatatctcatagctttgtgcctgggtagtcttaatagttgcttagatccattcctttattttctcatgtcaaaaaccagaaatcactccactgcttaccttacaaaatagtgaaatgatcttagagaacaaggacagccatcacagagaacgtctgttttcaagaacaacataagcatagtgcaaggagctccatttccgagctcctaagaaatatgcttcaaaggtcaaacattacaaaagcattagtagtttgtttgtttgtttttgagactgagtctcactttatcacccagactggcgtgcagtggcactatcttggctcattgcaacctctgcctcccaggtcagcctcccaagtagctgggattacaccaccatgcccagctactaaaaatacttgtatttttagtagagacggggtttcaccatgttgaccaggctggtcttgaactcctgacctcaagtgatcttccggcctcagcctcccaaagtgctggattacaggcgtgagccactgagccagccagcattagtaatttttaaaaacactttatcagtattttaaaaatgttaatgcaggagaaaagatatcacaactctatggaaaatgacatttccatttgccttattgctacttcaagctctttaaatcaccatcttccctatttc

SEQ ID NO: 2998 - DNA, 1534 bp; single-stranded, linear
tcatgtgggggcgactgctcctgtggcccctggtgctggggttcagcctgtctggcggcacccagacccccagcgtctacgacgagagcgggagcaccggaggtggtgatgacagcacgccctcaatcctgcctgccccccgcggctacccaggccaagtctgtgccaatgacagtgacaccctggagctcccggacagctcacgggcactgcttctgggctgggtgcccaccaggctggtgcccgccctctatgggctggtcctggtggtggggctgccggccaatgggctggcgctgtgggtgctggccacgcaggcacctcggctgccctccaccatgctgctgatgaacctcgcgactgctgacctcctgctggccctggcgctgcccccgcggatcgcctaccacctgcgtggccagcgctggcccttcggggaggccgcctgccgcctggccacggccgcactctatggtcacatgtatggctcagtgctgctgctggccgccgtcagcctggatcgctacctggccctggtgcacccgctgcgggcccgcgccctgcgtggccggcgcctggcccttggactctgcatggctgcttggctcatggcggccgccctggcactgcccctgacactgcagcggcagaccttccggctggcgcgctccgatcgcgtgctctgccatgacgcgctgcccctggacgcacaggcctcccactggcaaccggccttcacctgcctggcgctgttgggctgtttcctgcccctgctggccatgctgctgtgctacggggccaccctgcacacgctggcggccagcggccggcgctacggccacgcgctgaggctgaccgcagtggtgctggcctccgccgtggccttcttcgtgcccagcaacctgctgctgctgctgcattactcggacccgagccccagcgcctggggcaacctctatggtgcctacgtgcccagcctggcgctgagcaccctcaacagctgcgtggatcccttcatctactactacgtgtcggccgagttcagggacaaggtgcgggcagggctcttccaacggtcgccgggggacaccgtggcctccaaggcctctgcggaagggggcagccggggcatgggcacccactcctctttgctccagtgacacaaagtggggaaggctgtactgggtcgaacagggtcccttcccccacttcacgtccttcctgggacctcagaatgtgaccttatttggaaatagggttgttacaactgtcactagcagaggtcactttggagaagggtgggccttacatccagtgtgggtggtgtcctcataagataaggagaggccaggcctggtggctcacgcctgtaatcccagcactttaagaggccaaggcggatggatcacttgagcccaggagttcaacaccagcctgagcaacatggtaaaaccccatctctaccaaaaatacaaaaattagctgggcttggtggctggcgcctgtaatcccagctactcangagactgaggca

SEQ ID NO: 2999 - DNA, 3182 bp; single-stranded, linear
cgcacccgggcccgcaggccagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctcgtcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatcatttccacggtctgttatgtgtctatcattcgatgtcttagctcttccgcagttgccaaccgcagcaagaagtcccgggctttgttcctgtcagctgctgttttctgcatcttcatcatttgcttcggacccacaaacgtcctcctgattgcgcattactcattcctttctcacacttccaccacagaggctgcctactttgcctacctcctctgtgtctgtgtcagcagcataagctcgtgcatcgaccccctaatttactattacgcttcctctgagtgccagaggtacgtctacagtatcttatgctgcaaagaaagttccgatcccagcagttataacagcagtgggcagttgatggcaagtaaaatggatacctgctctagtaacctgaataacagcatatacaaaaagctgttaacttaggaaaagggactgctgggaggttaaaaagaaaagtttataaaagtgaataacctgaggattctattagtccccacccaaactttattgattcacctcctaaaacaacagatgtacgacttgcatacctgctttttatgggagctgtcaagcatgtatttttgtcaattaccagaaagataacaggacgagatgacggtgttattccaagggaatattgccaatgctacagtaataaatgaatgtcacttctggatatagctaggtgacatatacatacttacatgtgtgtatatgtagatgtatgcacacacatatattatttgcagtgcagtatagaataggcactttaaaacactctttccccgcaccccagcaattatgaaaataatctctgattccctgatttaatatgcaaagtctaggttggtagagtttagccctgaacatttcatggtgttcatcaacagtgagagactccatagtttgggcttgtaccacttttgcaaataagtgtattttgaaattgtttgacggcaaggtttaagttattaagaggtaagacttagtactatctgtgcgtagaagttctagtgttttcaattttaaacatatccaagtttgaattcctaaaattatggaaacagatgaaaagcctctgttttgatatgggtagtattttttacattttacacactgtacacataagccaaaactgagcataagtcctctagtgaatgtaggctggctttcagagtaggctattcctgagagctgcatgtgtccgcccccgatggaggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttaaaaacaacgaaagaaggcatggacttctggatgcccatccactgggtgtaaacacatctagtagttgttctgaaatgtcagttctgatatggaagcacccattatgcgctgtggccactccaataggtgctgagtgtacagagtggaataagacagagacctgccctcaagagcaaagtagatcatgcatagagtgtgatgtatgtgtaataaatatgtttcacacaaacaaggcctgtcagctaaagaagtttgaacatttgggttactatttcttgtggttataacttaatgaaaacaatgcagtacaggacatatattttttaaaataagtctgatttaattgggcactatttatttacaaatgttttgctcaatagattgctcaaatcaggttttcttttaagaatcaatcatgtcagtctgcttagaaataacagaagaaaatagaattgacattgaaatctaggaaaattattctataatttccatttacttaagacttaatgagactttaaaagcattttttaacctcctaagtatcaagtatagaaaatcttcatggaattcacaaagtaatttggaaattaggttgaaacatatctcttatcttacgaaaaaatggtagcattttaaacaaaatagaaagttgcaaggcaaatgtttatttaaaagagcaggccaggcgcggtggctcacgcctgtaatcccagcactttgggaggctgaggcgggtggatcacgaggtcaggagatcgagaccatcctggctaacacggtgaaacccgtctctactaaaaatgcaaaaaaaattagccgggcgtggtggcaggcacctgtagtcccagctactcgggaggctgaggcaggagactggcgtgaacccaggaggcggaccttgtagtgagccgagatcgcgccactgtgctccagcctgggcaacagagcaagactccatctc

SEQ ID NO: 3000 - DNA, 6546 bp; single-stranded, linear
cctgcctgcacggcacaggagagcaaacttctacagacagaccaaggcttccatttgctgctgacacatggaactgaggtgaaattgtgctccatgattttacagatttcataacgtttaagagacgggactcaggtcatcaaaatgaaagccctcatctttgcagctgctggcctcctgcttctgttgcccactttttgtcagagtggcatggaaaatgatacaaacaacttggcaaagccaaccttacccattaagacctttcgtggagctcccccaaattcttttgaagagttccccttttctgccttggaaggctggacaggagccacgattactgtaaaaattaagtgccctgaagaaagtgcttcacatctccatgtgaaaaatgctaccatggggtacctgaccagctccttaagtactaaactgatacctgccatctacctcctggtgtttgtagttggtgtcccggccaatgctgtgaccctgtggatgcttttcttcaggaccagatccatctgtaccactgtattctacaccaacctggccattgcagattttcttttttgtgttacattgccctttaagatagcttatcatctcaatgggaacaactgggtatttggagaggtcctgtgccgggccaccacagtcatcttctatggcaacatgtactgctccattctgctccttgcctgcatcagcatcaaccgctacctggccatcgtccatcctttcacctaccggggcctgcccaagcacacctatgccttggtaacatgtggactggtgtgggcaacagttttcttatatatgctgccatttttcatactgaagcaggaatattatcttgttcagccagacatcaccacctgccatgatgttcacaacacttgcgagtcctcatctcccttccaactctattacttcatctccttggcattctttggattcttaattccatttgtgcttatcatctactgctatgcagccatcatccggacacttaatgcatacgatcatagatggttgtggtatgttaaggcgagtctcctcatccttgtgatttttaccatttgctttgctccaagcaatattattcttattattcaccatgctaactactactacaacaacactgatggcttatattttatatatctcatagctttgtgcctgggtagtcttaatagttgcttagatccattcctttattttctcatgtcaaaaaccagaaatcactccactgcttaccttacaaaatagtgaaatgatcttagagaacaaggacagccatcacagagaacgtctgttttcaagaacaacataagcatagtgcaaggagctccatttccgagctcctaagaaatatgcttcaaaggtcaaacattacaaaagcattagtagtttgtttgtttgtttttgagactgagtctcactttatcacccagactggcgtgcagtggcactatcttggctcattgcaacctctgcctcccaggtcagcctcccaagtagctgggattacaccaccatgcccagctactaaaaatacttgtatttttagtagagacggggtttcaccatgttgaccaggctggtcttgaactcctgacctcaagtgatcttccggcctcagcctcccaaagtgctggattacaggcgtgagccactgagccagccagcattagtaatttttaaaaacactttatcagtattttaaaaatgttaatgcaggagaaaagatatcacaactctatggaaaatgacatttccatttgccttattgctacttcaagctctttaaatcaccatcttccctatttctcatgtgggggcgactgctcctgtggcccctggtgctggggttcagcctgtctggcggcacccagacccccagcgtctacgacgagagcgggagcaccggaggtggtgatgacagcacgccctcaatcctgcctgccccccgcggctacccaggccaagtctgtgccaatgacagtgacaccctggagctcccggacagctcacgggcactgcttctgggctgggtgcccaccaggctggtgcccgccctctatgggctggtcctggtggtggggctgccggccaatgggctggcgctgtgggtgctggccacgcaggcacctcggctgccctccaccatgctgctgatgaacctcgcgactgctgacctcctgctggccctggcgctgcccccgcggatcgcctaccacctgcgtggccagcgctggcccttcggggaggccgcctgccgcctggccacggccgcactctatggtcacatgtatggctcagtgctgctgctggccgccgtcagcctggatcgctacctggccctggtgcacccgctgcgggcccgcgccctgcgtggccggcgcctggcccttggactctgcatggctgcttggctcatggcggccgccctggcactgcccctgacactgcagcggcagaccttccggctggcgcgctccgatcgcgtgctctgccatgacgcgctgcccctggacgcacaggcctcccactggcaaccggccttcacctgcctggcgctgttgggctgtttcctgcccctgctggccatgctgctgtgctacggggccaccctgcacacgctggcggccagcggccggcgctacggccacgcgctgaggctgaccgcagtggtgctggcctccgccgtggccttcttcgtgcccagcaacctgctgctgctgctgcattactcggacccgagccccagcgcctggggcaacctctatggtgcctacgtgcccagcctggcgctgagcaccctcaacagctgcgtggatcccttcatctactactacgtgtcggccgagttcagggacaaggtgcgggcagggctcttccaacggtcgccgggggacaccgtggcctccaaggcctctgcggaagggggcagccggggcatgggcacccactcctctttgctccagtgacacaaagtggggaaggctgtactgggtcgaacagggtcccttcccccacttcacgtccttcctgggacctcagaatgtgaccttatttggaaatagggttgttacaactgtcactagcagaggtcactttggagaagggtgggccttacatccagtgtgggtggtgtcctcataagataaggagaggccaggcctggtggctcacgcctgtaatcccagcactttaagaggccaaggcggatggatcacttgagcccaggagttcaacaccagcctgagcaacatggtaaaaccccatctctaccaaaaatacaaaaattagctgggcttggtggctggcgcctgtaatcccagctactcangagactgaggcacgcacccgggcccgcaggccagaatcaaaagcaacaaatgccaccttagatccccggtcatttcttctcaggaaccccaatgataaatatgaaccattttgggaggatgaggagaaaaatgaaagtgggttaactgaatacagattagtctccatcaataaaagcagtcctcttcaaaaacaacttcctgcattcatctcagaagatgcctccggatatttgaccagctcctggctgacactctttgtcccatctgtgtacaccggagtgtttgtagtcagcctcccactaaacatcatggccatcgttgtgttcatcctgaaaatgaaggtcaagaagccggcggtggtgtacatgctgcacctggccacggcagatgtgctgtttgtgtctgtgctcccctttaagatcagctattacttttccggcagtgattggcagtttgggtctgaattgtgtcgcttcgtcactgcagcattttactgtaacatgtacgcctctatcttgctcatgacagtcataagcattgaccggtttctggctgtggtgtatcccatgcagtccctctcctggcgtactctgggaagggcttccttcacttgtctggccatctgggctttggccatcgcaggggtagtgcctctcgtcctcaaggagcaaaccatccaggtgcccgggctcaacatcactacctgtcatgatgtgctcaatgaaaccctgctcgaaggctactatgcctactacttctcagccttctctgctgtcttcttttttgtgccgctgatcatttccacggtctgttatgtgtctatcattcgatgtcttagctcttccgcagttgccaaccgcagcaagaagtcccgggctttgttcctgtcagctgctgttttctgcatcttcatcatttgcttcggacccacaaacgtcctcctgattgcgcattactcattcctttctcacacttccaccacagaggctgcctactttgcctacctcctctgtgtctgtgtcagcagcataagctcgtgcatcgaccccctaatttactattacgcttcctctgagtgccagaggtacgtctacagtatcttatgctgcaaagaaagttccgatcccagcagttataacagcagtgggcagttgatggcaagtaaaatggatacctgctctagtaacctgaataacagcatatacaaaaagctgttaacttaggaaaagggactgctgggaggttaaaaagaaaagtttataaaagtgaataacctgaggattctattagtccccacccaaactttattgattcacctcctaaaacaacagatgtacgacttgcatacctgctttttatgggagctgtcaagcatgtatttttgtcaattaccagaaagataacaggacgagatgacggtgttattccaagggaatattgccaatgctacagtaataaatgaatgtcacttctggatatagctaggtgacatatacatacttacatgtgtgtatatgtagatgtatgcacacacatatattatttgcagtgcagtatagaataggcactttaaaacactctttccccgcaccccagcaattatgaaaataatctctgattccctgatttaatatgcaaagtctaggttggtagagtttagccctgaacatttcatggtgttcatcaacagtgagagactccatagtttgggcttgtaccacttttgcaaataagtgtattttgaaattgtttgacggcaaggtttaagttattaagaggtaagacttagtactatctgtgcgtagaagttctagtgttttcaattttaaacatatccaagtttgaattcctaaaattatggaaacagatgaaaagcctctgttttgatatgggtagtattttttacattttacacactgtacacataagccaaaactgagcataagtcctctagtgaatgtaggctggctttcagagtaggctattcctgagagctgcatgtgtccgcccccgatggaggactccaggcagcagacacatgccagggccatgtcagacacagattggccagaaaccttcctgctgagcctcacagcagtgagactggggccactacatttgctccatcctcctgggattggctgtgaactgatcatgtttatgagaaactggcaaagcagaatgtgatatcctaggaggtaatgaccatgaaagacttctctacccatcttaaaaacaacgaaagaaggcatggacttctggatgcccatccactgggtgtaaacacatctagtagttgttctgaaatgtcagttctgatatggaagcacccattatgcgctgtggccactccaataggtgctgagtgtacagagtggaataagacagagacctgccctcaagagcaaagtagatcatgcatagagtgtgatgtatgtgtaataaatatgtttcacacaaacaaggcctgtcagctaaagaagtttgaacatttgggttactatttcttgtggttataacttaatgaaaacaatgcagtacaggacatatattttttaaaataagtctgatttaattgggcactatttatttacaaatgttttgctcaatagattgctcaaatcaggttttcttttaagaatcaatcatgtcagtctgcttagaaataacagaagaaaatagaattgacattgaaatctaggaaaattattctataatttccatttacttaagacttaatgagactttaaaagcattttttaacctcctaagtatcaagtatagaaaatcttcatggaattcacaaagtaatttggaaattaggttgaaacatatctcttatcttacgaaaaaatggtagcattttaaacaaaatagaaagttgcaaggcaaatgtttatttaaaagagcaggccaggcgcggtggctcacgcctgtaatcccagcactttgggaggctgaggcgggtggatcacgaggtcaggagatcgagaccatcctggctaacacggtgaaacccgtctctactaaaaatgcaaaaaaaattagccgggcgtggtggcaggcacctgtagtcccagctactcgggaggctgaggcaggagactggcgtgaacccaggaggcggaccttgtagtgagccgagatcgcgccactgtgctccagcctgggcaacagagcaagactccatctc

SEQ ID NO: 3001 - DNA, 12 bp; single-stranded, linear
tcgttcctctcg

SEQ ID NO: 3002 - DNA, 117608 bp; single-stranded, linear
ggcggcctggaaagctgagatggagggcggcatggcgggcacaggctgggctgcttttcttttctgggcctctgtggtctgtttttttctggccctgctggggcgctctccgccgcccgcctggctcccggbgcccbtgbtgggcbtgccgtggttcttgccctcctttggctgccgtgcccgctccccggcctcctggcgggtggccgttgggcccgtgttcccctggggcctggggctcccttctctcgcccttcttgctgggcctctgctgctgctggtgctgtggcccccgtacaccgaggagcccatgatgggcatgccacagacgacaggcgtbcbccgbggbgcccbtgbtgggcbtgccbcbgbcgbcbggcggcgccgtgccgcgtcttggtggcggcgggttcgcgcccgcgcggggcccctccggtccgttcgcgcccgcgcggggcccctccggtcccgggtcggggccccccgcggccgcctcggggctggggcgctggtggccgggccgcgcctccgcctgccgcttctggctgggccccgggcgccccctcccctcttgctcgggtccccgtgacagcgcgtcctgtgtctccagcagcatggccgggccagctgggccccbcbgcgcgtcctgtgtctccbgcbgcbtggccgggccbgctgggccccacagagcagtgctgttgttgggcatcttgccttcccagggbcbgbgcbtgctgttgttgggcbtcttgccttcccbgggcccttttctggtggggtggtgctgttgttgggctttcttctgttcccbcbgbgcbgtgctgttgttgggcbtcttgccttcccbgggcccttttctggtggggtggtgctgttgttgggctttcttctgttccctttcccctgggtcttccctcctgctcttttttcatttgctctcctattactttctgtgtccattttttcattaaccgagctgtbtttgctctcctbttbctttctgtgtccbttttttcbttbbccgbgctgtgcctgtgtctgtcctcctgcttcgttcctctcgttcctgcttggtgcccttgccggtcctgctcctccgggctgtgggtcgtggccctggctccggctggtgggctcccctggccttcgctggctggcggcgtgcgggtcttgctctgggcctggctgtggccgtggttgggggtcttcgctgcctccgtttgggtggctctctgaatattgaccttcctccatggcggtcctgcttggattctcccgatctctgbbtbttgbccttcctccbtggcggtcctgcttggbttctcccgbgcctttcctggttctcttgttgtttttggggtttggcttacagtagagtaggggattccatggcaggagccatcttcttcatggactccttcaaggagaccttaggtttctgagggactgctaacacgccatctggagcbcbgtbgbgtbggggbttccbtggcbggbgccbtcttcttcbtggbctccttcbbggbgbccttbggtttctgbgggbctgctbbcbcgccbtctggbgcgttgtttttggggtttggcttgcctttcctggttctcttbcbgtbgbgtbggggbttccbtggcbggbgccbtcttcttcbtggbctccttcbbggbgbccttbggtttctgbgggbctgctbbcbcgccbtctggbgcgcctgtgtctgtcctcctgcttcgttcctctcgttcctgcttggtgcccttgccggtcctgctcctccgggctgtgggtcctcgccctggctccggctggtgggctcccctggccttcgctggctggcggcgtgccccbgbbcgbgbcccggbccgbcbggccgtggttgggggtcttcgctgcctccgtttgggtggcgatctctgaatattgaccttccatggcggtcctgcttggagbtctctgbbtbttgbccttccbtggcggtcctgcttggbtctggggtgtcctggccttcgtggttcctcttccttcgtttgccgtccgcgggggcccccgggcctggctgcgctcctgccccgcctctttcccgggctcttgcgctggggggtgctcccgtgtgtttgcgccctcctcctggtcgcgcttgtcgttttggggccggctttgcccgcctcccggcgcctggcccggccttcctgggctgcgtgcgcgttctgttcttcttcctggctctggggtgtcctggccttcgtggttcctcttccttcgtttgccgtccgcgggggcccccgggcctggctgcgctcctgccccgcctctttcccgggctcttgcgctggggggtgctcccgtgtgtttgcgccctcctcctggtcgcgcttgtcgttttggggccggctttgcccgcctcccggcgcctggcccggccttcctgggctgcgtgcgcgttctgttcttcttcctggcgcaggagacagggcagggcgatcaggagcagcgtgagccaaaggaggaccatcgggaacgcagctccggaacgcaggacagaggtgccgcbggbgbcbgggcbgggcgbtcbggbgcbgcgtgbgccbbbggbggbccbtcgggbbcgcbgctccggbbcgcbggbcbgbggtgcctctgccctgtccgccggctcttcggtggctcggccccgctccttgtcttgccgcgggttggttcctgggcctggttcttgcgggcgtttcggtctgctggctggtctgggcccgcggtgcggcgggtggcttgctgttctgcctgggctctcccctctcctccttttctcccttcctctgtcttgcctccttcctctgggtcctcttggcctgggcgctcttcccctcgggcggctgcgggcgctcgtgctgcctggtccgctccctgggggtgctccttccctttccccgctcgtggggtttgcggggctgggctgccctggggggtctgggccttttggggtcggctggctgctgcttcgggccgcctgggcttccctgtgcccctttcctctgctgggtccccctcccgttccaagctgcaccgcacagaccggcgctacaggacagagccaggcaagcacccatggggatccaggcccagctgttccbbgctgcbccgcbcbgbccggcgctbcbggbcbgbgccbggcbbgcbcccbtggggbtccbggcccbgctgctcagtggcccccaaaaggatgagtaatacatgcgccacgatgatcatatcctttttactatgaggccgtgtctgtcgtgtctttcctttgctcttggtgtgtctttgctgtgccctgcctctctgcccgtgtctgtcgtgtctttcctttgctcttggtgtgtctttgctgtgccctgcctctctgcccgtgtctgtcgtgtctttcctttgctcttggtgtgtctttgctgtgccctgcctctctgcgggggtggcttcctgccgcgtctctgggccgtcccgtccctcggccccgcgccgcgctcggctcctctccctctggcccggctcggggcggggcggggcggtgggcgggcggcgctgccctgcgcgcggcgctggcccctgctggccgtcggctgcgcgctgctggctgccctgctggccgcgccggggcctgtccgcctctgcgggcgctgtctcctggcttgtcttccggctcttctgctggggtggggctgggcggccggcccggtgctggggctcctcgggggggggggctcttccgggctgtctccctccggggcgggggtttctggccgtgggggtcttgcctggcctccgggctcctgcttgtcttgccttccttctctggtcggttgtggctcggggctccgtgggtccctggcgcccgtttgtgttttgtcttttcccctggcgtccctgtgcccctctcctctccttcctctgcttctcgctctcctttgtggggccctccctgctgctcttggttttgggctttttttctcttcctcctttttcgtgcgtgggcctccgcacgcctcttgccacctcctgcgcagggcagcgccttggggccagcgccgctcccggcgcggccagcagggcagccagcagcgcgcagccgacggccagcatgcttcctcctcggctaccactccatggtcccgcagaggcggacaggcgcbcgcctcttgccbcctcctgcgcbgggcbgcgccttggggccbgcgccgctcccggcgcggccbgcbgggcbgccbgcbgcgcgcbgccgbcggccbgcbtgcttcctcctcggctbccbctccbtggtcccgcbgbggcggbcbggcgctgcccggcggggtgtgcgcttggcgctcccgtgctcggttctctgtctcccggtcccccttgcctggcgtctcgggccttcgtcctcttcctcttcttccttccgctccgtgggggctgcttggtgggggcctgtgcctcggggtcccggggcttctggcccttgccgttcatggtggctaggtggggcgttcbtggtggctbggtggggcggggtgggtbggccgtgtctgggggttggccbtgttggttgcctcttggtggtgcgccgggcgcgtcttggctttcttctccttcgggccctcgggccggtgcttgtgggctcctcccgggcggcctccccgggcgggggcttcttggcgctggcgggggggcctcctgctctgtggctgggcgttccttggtgttctgggtggtggcgggcgtggtggcctctgtgggggcccgcggctgcbggggttgcctgtctgcttcgtcctttgcgctcccgggccgccggggtgggtaggccgtgtctgggggttggccatgttggttgccgggcccgcggctgcaggggacaggggctgtaatcttcatctgcaggtggcatgccagtgaaatttagatcatcaaaatcccacatctgtggatctgtaatatttgacatgtcctcttcagtttcagcaatggtttgatctaactgaagcaccggccaggbcbggggctgtbbtcttcbtctgcbggtggcbtgccbgtgbbbtttbgbtcbtcbbbbtcccbcbtctgtggbtctgtbbtbtttgbcbtgtcctcttcbgtttcbgcbbtggtttgbtctbbctgbbgcbccggccbggtggctcggtgcttctgcccctgttgttgcggcgctcggttggtgtggcccctgtggtgcttcgtttccccctctttctctttgttcgggggttcttgtggcgggctgcttgtctcgttccgccctgtcgggcgggaagcctctctcctctccccagatccgcgacaggccgcaggcaagaaccagcgcaaccagggcgcgtccgcacagacttggaggcggctgcatgctgctacctgctccagaagcgtccggtggccgccgcgccctgtcgggcgggbbgcctctctcctctccccbgbtccgcgbcbggccgcbggcbbgbbccbgcgcbbccbgggcgcgtccgcbcbgbcttggbggcggctgcbtgctgctbcctgctcgggcgggbbgcctccggtggccgccgcgcgtccggtggccgccgcgcctctctcctctccccgtggccctgtcgggcgggtcctgccgtcctgtctccttttcttttgctgtcttgtcttcccgtctctgctttgtctgtcctccccgtctcctcccactgcttctcccgggggcttccccggcttcgggtggccggtgtcccgggctccggcgcggcggcggcttcggctgcgggtgggtggcgcgggctgccgggtccgcgcggcgcctgggcccttgtgctgctttttgcttgttccgttctggctgctccggtctgtgttgtggttgttttgtttcttcttgggtgtgggccttgcggttttggctgtgggccctttggggccttggcttctggctcgtctgtcctccccgtctcctcccactgcttctcccgggggcttccccggcttcgggtggccggtgtcccgggctccggcgcggcggcggcttcggctgcgggtgggtggcgcgggctgccgggtccgcgcggcgcctgggcccttgtgctgctttttgcttgttccgttctggctgctccggtctgtgttgtggttgttttgtttcttcttgggtgtgggccttgcggttttggctgtgggccctttggggccttggcttctggctccatccacatgattgcttagatttgtgctgtatctctcaggattatcactgattacacatccaaccagtgccagccaaaaggatgccctgaggcaaagggtttccatcttgaggcaaatttgaggacbtccbcbtgbttgcttbgbtttgtgctgtbtctctcbggbttbtcbctgbttbcbcbtccbbccbgtgccbgccbbbbggbtgccctgbggcbbbgggtttccbtcttgbggcbbbtttgbggbgggctbbgbtgbtccbcbtcbctbccbcgttgcccbccbcbgbggtcbccbcbbtgbccgtgtbggcbgctgcccbbbggbcbbtttgccbggctggttgcbcgbbctgbttgggttccgbggtgttbgtggbgbtgtttggggbgbggtctgbgtccbccgggbggbcgttbtccbtttcgbbgctbggcggtbbbgccctbctbtctgtbcbcbbcccccctctgcbgcbgbgtcctgtcgtggcgcctggggctcbgggtccgggctaagatgatccacatcactaccacgttgcccaccacagaggtcaccacaatgaccgtgtaggcagctgcccaaaggacaatttgccaggctggttgcacgaactgattgggttccgaggtgttagtggagatgtttggggagaggtctgagtccaccgggaggacgttatccatttcgaagctaggcggtaaagccctactatctgtacacaacccccctctgcagcagagtcctgtcgtggcgcctggggctcagggtccgtcctgtcgtggcgcctggggctcttcttttgtgggctctttggtggctgtggctgtggtctctgtggttgctgccctgggtctgggggtgtggccttggggccgtcctctggctcctcctcgtgggcccccggtgbcbttgbgcbtgtcggcgcggtcccgttbbgbgtgggcccgccagcccagccactccacttgggggcgggtggccagcacgaacagcacccagaggaaggggggcggcccagaagggcagcccgcaggccaggatcaggtctgctgcggccggagataatggcattcaccacgcggcggcccagcgcacgccgcgcatccggcccgggttctgacctgcagcccccgtctccttggcattcctgggccccagtcactcctctccctgccccccttgctggggcagggacggggtgbcbttgbgcbtgtcggcgcggtcccgttbbgbgtgggcccgccagcccagccactccacttgggggcgggtggccagcacgaacagcacccagaggaaggggggcggcccagaagggcagcccgcaggccaggatcaggtctgctgcggccggagataatggcattcaccacgcggcggcccagcgcacgccgcgcatccggcccgggttctgacctgcagcccccgtctccttggcattcctgggccccagtcactcctctccctgccccccttgctggggcagggacggccgtgttgtcbgtggtgctgcccgtttgbggtbtggcgctccbccbbttcccttttctccttgttttccgtttctcttgccgtctgtggttatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtctcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgcccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagatgagtgtcagaagtgtgaagggtgcctgttctgaatcccagagcctcctctccctctgtgaggctggcaggtgaggaagggtttaacctcactggaaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctacgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagcgcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatgatttgctggagtgctggctccacgccctggggagtgagcttggtgcggtaggtgctggcctcaaacagccacgaggtggtagctctgagccctccttcttgccctgagctttccggggaggagcctggagtgtaattacctgtcatctgggccaccagctccactggcccccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggaggagtacccccctgagagcatgtgggggaaggccttgctgtcatgtgaatccctcaatacccctagtatctggctgggttttcaggggctttggaagctctgttgcaggtgtccgggggtctaggactttagggatctgggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcggttgaccttctgaacatgagtgtcaactccaggacttgcttccaagcccttccctctgttggaaattgggtgtgccctggctcccaagggaggcccatgtgactaataaaaaactgtgaaccctcgcatttgtgttttaataaaagaatctggaagataaatagtcttgaagagagacaaaggaaggaaaatttaaatccttagattcaagcagaagaattccatgtggaaggtttgggttgttgttgttgttgtttggtgtgttttttgtttttttgtttttttgtttttttttgagatggagtctcgctgtgttaccgggagcgacagagccgcacggccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccgcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagacccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtagcaccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatgtatacttgttgccaggaaggtgacctcaaaaattaaaagtataattattcggccgggcatggtggctcacacctgtaattccagcactttgggaggccaaggcaggcggatcacgaggtcaggagttcaaaaccagcctgtccaatatagtggggcaatttgttagttatccgccgccaccaagacgcggcacggcgcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatggaattcccagatgggcagaggtggctgggctggtgaccctaagtgtgtctcctgcctttattctctctagtgggttattctttcatgtggtatcttgcctacagcatgctgtgtttggacacaaacccctttccttggtttctctgacccagctgagatggactgattccaaaagaactcacctatgtactggggtaggggagggagggttttttgcagtatttaactaaggttcaaagagtgctatatagtgagaaaggcttcttttttttttttttttttttttggcagagtgctgcctcctagaaatttctcttggtaacttccttctctgaagcacagataaagaaaacaattacagtagaaacatttatgagggacacattggaggccgatgaagcttttcaagttccagcagtgcagggatgtgggcagaactgacattggaaaatactagaatgatggaaattcagttggagaggactgccctttttaatgtctggggagtctgctcagggagaaatgacaagtctggcggggacaagtatgggatttggtaagacttggatcaacttgggatacagggtgggggtcgggagtggaatcaatgaatgatgccagagcagatcaactaacaagaggaccctgatgagccccaggcagaggcgtctcccttatgccccactctgaagtgtttgttagtaaacaccagaacgccattgttgttactgctgaattttattttgggctgtacatatttagatgcttaaggtaaaaatgataaagccctcaagccactgtgtgggtttgggtccaagtgttccttcttgctgcctctctaacacgcctggttaaaataatccctttggatggtgctgagaagcacctgaaccaagtgggtccccaaataacaatggcgtgcaagtgtctggttcccagaagttggtgactaggtaagcagcttcagggagagggggctgattcccagacagtcgcctgttcctgcggggatggggctgaggcttggggaatgtgggcaggaggatatgccatttgattctgttgcacacgttcttttcccttctttctgtatgtctggtcattctgctattctgtcgttcctcacataggttggacattggccggctgccagcataagtgccagtgtgattttgctaggtgtgagctgagaaagagaggtggaggctaagcaggtgtgatgcttctcagaggtgctgagtttttgcccttctgagcagggaatctttgcttatccctttgaccaaggatctttgctgcaaaggctgggtatcggctgtgctcagcaaagcgtcaactcgtgcaagaacttagcaggaatagttctggctaaggttaggaggctgccaccaaagtctcttttttgttcctctgcttctcccgtttgcctccttatcatgagatctttttgctaagctggcagaaagattgcatagtcagtgcttccagctctgctcccacctgatcctgcactgtcctctggtccctgaatgaatgaactctgatacccaatcttgtctcgagccttctctatgccactcatggctcctcttctgctctttccatctttttgctgagagttctgagctctgtacttcctcttggcccatctcacttcctgaaacacccctgaagagggttgcttatcttgatggaactcaaaaagccaaaaagctgcaggcagaggcgttgaggacatctgtttggggaactaagagcagcagcactttcagattcagtccatatagagctgtcctacagcattctggaaacttgaggatgtgcggtgcataaaggggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcaggtagcctgcggcgtggggtgggcagcaattgaggcagctgggaaatgaggctacaaagccagagcctgctgaattttattttggactgtacatatttagatgcttaaggtaaaaatgataaagccctcaagccactgtgtgggttgggtccaagtgttccttgctgctgcctctctaacacgcctggttaaaataatccctttggatggtgctgagaagcacctgaaccaagtgggtccccaaataactatggcgtgcaagtgtctggttcccagaagttggtgactaggtaagcgactcagggagaggggctgattcccagacagtcgcctgttcctgctgggatggggctgaggcttggggaatgtgggcaggaggatatgccatttgattctgttgcacacgttcttttcccttctttctgtatgtctggtcattctgctattctgtcgttcctcacataggttggacattggccggctgccagcataagtgccagtgtgattttgctagggtgtgagctgagaaagagaggtggaggctaagcaggtgtgatgcttctcagaggtgctgagtttttgcccttctgagcagggaatctttgcttatccctttgaccaaggatctttgctccaaaggctgggtatcggctgtgctcagcaaagcgtcaactcgtgcaagaacttagcaggaatagttctggctaaggttaggaggctgccaccaaagtctcttttttgttcctctgcttctcccgtttgcctccttatcatgagatctttttgctaagctggcagaaagattgcataatcagtgcttccagctccgctcccacctgatcctgcactgtcctctggtccctgaatgaatgaactctgatacccaatcttgtctcgagccttctctatgccactcatggctcctcttctgctctttccatctttttgctgagagttactgagctctgtacttcctcttggcccatctcacttcctgaaacacccctgaagagggttgcttatcttgatggaactcaaaaagccaaaaagctgcaggcagaggcgttgaggacatctgtttggggaactaagagcagcagcactttcagattcagtccatatagagctgtcctacagcattctggaaacttgaggatgtgcggtgcataaaggggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgcgaattcgggggacatctgtttggggaactaagagcagcagcactttcagattcagtccatatagagctgtcctacagcattctggaaacttgaggatgtgcggtgcataaacgggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcagatacaagagggtcaccactcacagaagaatatggctggccctgggcctttgctggctggtgtcattcctggtgggattgacccccatgtttggctggaacatgaaactgacctcagagtaccacagaaatgtcaccttcctttcatgccaatttgtttccgtcatgaggatggactacatggtatacttcagcttcctcacctggattttcatccccctggttgtcatgtgcgccatctatcttgacatcttttacatcattcggaacaaactcagtctgaacttatctaactccaaagagacaggtgcattttatggacgggagttcaagacggctaagtccttgtttctggttcttttcttgtttgctctgtcatggctgcctttatctctcatcaactgcatcatctactttaatggtgaggtaccacagcttgtgctgtacatgggcatcctgctgtcccatgccaactccatgatgaaccctatcgtctatgcctataaaataaagaagttcaaggaaacctaccttttgatcctcaaagcctgtgtggtctgccatccctctgattctttggacacaagcattgagaagaattctgagtagttatccatcagagatgactctgtctcattgaccttcagattccccatcaacaaacacttgagggcctgtatgcctgggccaagggatttttacatccttgattacttccactgaggtgggagcatctccagtgctccccaattatatctcccccactccactactctcttcctccacttcatttttcctttgtcctttctctctaattcagtgttttggaggcctgacttggggacaacgtattattgatattattgtctgttttccttcttcccaatagaagaataagtcatggagcctgaagggtgcctagttgacttactgacaaaaggctctagttgggctgaacatgtgtgtggtggtgactcatttccatgccattgtggaattgagcagagaacctgctctcggaggatgcctaggagatgttgggaacagaagaaataaactgagtttaagggggacttaaactgctgaattccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctggggggagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagacccaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccacctgtccctgcctcagttcccttttatgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaacctggagaggctagaaccaagaagggctagaacctggaggggctagaacctagagaagctaaaacctgagctagaagctggaggactagaacctggagggctggaatctgaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtgaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcaaaaaaaaaaaaaaaaaatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtctcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagatgagtgtcagaagtgtgaagggtgcctgttctgaatcccagagcctcctctccctctgtgaggctggcaggtgaggaagggtttaacctcactggaaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctacgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagcgcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatgatttgctggagtgctggctccacgccctggggagtgagcttggtgcggtaggtgctggcctcaaacagccacgaggtggtagctctgagccctccttcttgccctgagctttccggggaggagcctggagtgtaattacctgtcatctgggccaccagctccactggcccccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggaggagtacccccctgagagcatgtgggggaaggccttgctgtcatgtgaatccctcaatacccctagtatctggctgggttttcaggggctttggaagctctgttgcaggtgtccgggggtctaggactttagggatctgggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcggttgaccttctgaacatgagtgtcaactccaggacttgcttccaagcccttccctctgttggaaattgggtgtgccctggctcccaagggaggcccatgtgactaataaaaaactgtgaaccctcgcatttgtgttttaataaaagaatctggaagataaatagtcttgaagagagacaaaggaaggaaaatttaaatccttagattcaagcagaagaattccatgtggaaggtttgggttgttgttgttgttgtttggtgtgttttttgtttttttgtttttttgtttttttttgagatggagtctcgctgtgttaccgggagcgacagagccgcacggccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccgcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagacccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtagcaccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatgtatacttgttgccaggaaggtgacctcaaaaattaaaagtataattattcggccgggcatggtggctcacacctgtaattccagcactttgggaggccaaggcaggcggatcacgaggtcaggagttcaaaaccagcctgtccaatatagtggggcaatttgttagttatccgccgccaccaagacgcggcacggcgcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatggaattcccagatgggcagaggtggctgggctggtgaccctaagtgtgtctcctgcctttattctctctagtgggttattctttcatgtggtatcttgcctacagcatgctgtgtttggacacaaacccctttccttggtttctctgacccagctgagatggactgattccaaaagaactcacctatgtactggggtaggggagggagggttttttgcagtatttaactaaggttcaaagagtgctatatagtgagaaaggcttcttttttttttttttttttttttggcagagtgctgcctcctagaaatttctcttggtaacttccttctctgaagcacagataaagaaaacaattacagtagaaacatttatgagggacacattggaggccgatgaagcttttcaagttccagcagtgcagggatgtgggcagaactgacattggaaaatactagaatgatggaaattcagttggagaggactgccctttttaatgtctggggagtctgctcagggagaaatgacaagtctggcggggacaagtatgggatttggtaagacttggatcaacttgggatacagggtgggggtcgggagtggaatcaatgaatgatgccagagcagatcaactaacaagaggaccctgatgagccccaggcagaggcgtctcccttatgccccactctgaagtgtttgttagtaaacaccagaacgccattgttgttactgctgaattttattttgggctgtacatatttagatgcttaaggtaaaaatgataaagccctcaagccactgtgtgggtttgggtccaagtgttccttcttgctgcctctctaacacgcctggttaaaataatccctttggatggtgctgagaagcacctgaaccaagtgggtccccaaataacaatggcgtgcaagtgtctggttcccagaagttggtgactaggtaagcagcttcagggagagggggctgattcccagacagtcgcctgttcctgcggggatggggctgaggcttggggaatgtgggcaggaggatatgccatttgattctgttgcacacgttcttttcccttctttctgtatgtctggtcattctgctattctgtcgttcctcacataggttggacattggccggctgccagcataagtgccagtgtgattttgctaggtgtgagctgagaaagagaggtggaggctaagcaggtgtgatgcttctcagaggtgctgagtttttgcccttctgagcagggaatctttgcttatccctttgaccaaggatctttgctgcaaaggctgggtatcggctgtgctcagcaaagcgtcaactcgtgcaagaacttagcaggaatagttctggctaaggttaggaggctgccaccaaagtctcttttttgttcctctgcttctcccgtttgcctccttatcatgagatctttttgctaagctggcagaaagattgcatagtcagtgcttccagctctgctcccacctgatcctgcactgtcctctggtccctgaatgaatgaactctgatacccaatcttgtctcgagccttctctatgccactcatggctcctcttctgctctttccatctttttgctgagagttctgagctctgtacttcctcttggcccatctcacttcctgaaacacccctgaagagggttgcttatcttgatggaactcaaaaagccaaaaagctgcaggcagaggcgttgaggacatctgtttggggaactaagagcagcagcactttcagattcagtccatatagagctgtcctacagcattctggaaacttgaggatgtgcggtgcataaaggggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcaggtagcctgcggcgtggggtgggcagcaattgaggcagctgggaaatgaggctacaaagccagagcsctgctgaattttattttggactgtacatatttagatgcttaaggtaaaaatgataaagccctcaagccactgtgtgggttgggtccaagtgttccttgctgctgcctctctaacacgcctggttaaaataatccctttggatggtgctgagaagcacctgaaccaagtgggtccccaaataactatggcgtgcaagtgtctggttcccagaagttggtgactaggtaagcgactcagggagaggggctgattcccagacagtcgcctgttcctgctgggatggggctgaggcttggggaatgtgggcaggaggatatgccatttgattctgttgcacacgttcttttcccttctttctgtatgtctggtcattctgctattctgtcgttcctcacataggttggacattggccggctgccagcataagtgccagtgtgattttgctagggtgtgagctgagaaagagaggtggaggctaagcaggtgtgatgcttctcagaggtgctgagtttttgcccttctgagcagggaatctttgcttatccctttgaccaaggatctttgctccaaaggctgggtatcggctgtgctcagcaaagcgtcaactcgtgcaagaacttagcaggaatagttctggctaaggttaggaggctgccaccaaagtctcttttttgttcctctgcttctcccgtttgcctccttatcatgagatctttttgctaagctggcagaaagattgcataatcagtgcttccagctccgctcccacctgatcctgcactgtcctctggtccctgaatgaatgaactctgatacccaatcttgtctcgagccttctctatgccactcatggctcctcttctgctctttccatctttttgctgagagttactgagctctgtacttcctcttggcccatctcacttcctgaaacacccctgaagagggttgcttatcttgatggaactcaaaaagccaaaaagctgcaggcagaggcgttgaggacatctgtttggggaactaagagcagcagcactttcagattcagtccatatagagctgtcctacagcattctggaaacttgaggatgtgcggtgcataaaggggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgcgaattcgggggacatctgtttggggaactaagagcagcagcactttcagattcagtccatatagagctgtcctacagcattctggaaacttgaggatgtgcggtgcataaacgggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcagatacaagagggtcaccactcacagaagaatatggctggccctgggcctttgctggctggtgtcattcctggtgggattgacccccatgtttggctggaacatgaaactgacctcagagtaccacagaaatgtcaccttcctttcatgccaatttgtttccgtcatgaggatggactacatggtatacttcagcttcctcacctggattttcatccccctggttgtcatgtgcgccatctatcttgacatcttttacatcattcggaacaaactcagtctgaacttatctaactccaaagagacaggtgcattttatggacgggagttcaagacggctaagtccttgtttctggttcttttcttgtttgctctgtcatggctgcctttatctctcatcaactgcatcatctactttaatggtgaggtaccacagcttgtgctgtacatgggcatcctgctgtcccatgccaactccatgatgaaccctatcgtctatgcctataaaataaagaagttcaaggaaacctaccttttgatcctcaaagcctgtgtggtctgccatccctctgattctttggacacaagcattgagaagaattctgagtagttatccatcagagatgactctgtctcattgaccttcagattccccatcaacaaacacttgagggcctgtatgcctgggccaagggatttttacatccttgattacttccactgaggtgggagcatctccagtgctccccaattatatctcccccactccactactctcttcctccacttcatttttcctttgtcctttctctctaattcagtgttttggaggcctgacttggggacaacgtattattgatattattgtctgttttccttcttcccaatagaagaataagtcatggagcctgaagggtgcctagttgacttactgacaaaaggctctagttgggctgaacatgtgtgtggtggtgactcatttccatgccattgtggaattgagcagagaacctgctctcggaggatgcctaggagatgttgggaacagaagaaataaactgagtttaagggggacttaaactgctgaattcaaatgatagaccgtcaataatttgttaaatgctttttaaaatgaatgctttaagccgggtgcagtgcctcacatctgtaatcccagcactttggagccgagcgggtggattgtgtgaggtcaggagttcgagaccaacctggccaacatggcaaaacctcactctctaccaaaaatacaaaaattagccaggcatggtggcaggcacctgtgatcccagctactcaggaggctgagacaggagaatcgcttgaacccgggaggcaaggttgcagtgagccaagattacgccattgtactccagcctgggtgacagagagagactccgtctcaaaaaaaaaaaaaaaaaaaaaaaaattacgcttcaaacacatgatctctcaccactgttgaattttctttctatgagcccaggagggcctctcagagaggaaagctcctaggtcttcctttccctctgcaaactccctgccttgaaggttcagaaggactgtgcgtgctcgttgcatcctttgcaagtgtccaaaccctgatcccagctgtgcttaggggttcctgcaaaccttttccaggtgttaattacctcccacttcatttcctgtttaccaactcagctttttgttttagtgtgtttgaattccctgaactgaccgttgtctgatctccacctcccaactgaattaggggagctgggcttctggaaacccaggtgccgggtgttgcagagtggctgaaagctgggatgtggcagatccgtggctacattcatgcacacacacacacccacatacccacacatgcacacacacacacacacccgcactcacacacttggacatgcatagaccacagctttccacacccttcctagacaggggtcacttggtatcctggagagagtgtgaagtcctggaatggaaagaggggggattaagccccacctctagccatgggactgagacaagtcaccaccaacccatctgcgccttgtttacctcctctgtgaggcaagcacagagcccatgcctgcccccctggatgggagtgatgtgaaacttgaagggcggtcagagcaagggtcgggaatggaaggcccttgggaaaaaaggccctttcaactaggggcacagaggaggccctgggctgagaacttgacagcaccttgtaattggtaagccaagcccgaagggactggaaatactcagatgtgtctgtctcccttattaggttcaaagtccctcaagaccctgtctccatcacagtgctccagtccagacccctcctctgagctccagaccctgctggacccaaccagccctatggggtcgcatccccacctgcctggaattctccaaagaacctcccctttaacagttccagcctttaacagttccagtctaaacacatgacctttctcctctaaatcagccccccatctctgcctttgcaggagatggaagccatgacacctgcctcgcccctgtcctcaccccatccatgtccaatcaagcactaggcatgtcaggtttaccctctaaactcctctggaatccagtctctcagtctccatcatcccaggtcgaagctaatgggctaactggtccttgcttccactctacccccactgcagtcctgacttcctgagcagcagccagggcctaatcgatattcacaccaagcgccaacctgactgagatatcctcctgcaccatcatccctccaccctgtttagttctgctcaccctcagtgttctcatcaataatccactcccctcacaggcgcgtttgggaccccatgttctatgctctcacaggaccttttgcttgatttttcactgtacttaggtcagtttgcagttattaagtgactgagcaatgtctggcttctccagtagactgtcagctcctagccattgtatacctagcaccgctgtgtgggagcacgtgacaaacgtccagtgagtcagggactcagcagtctccatttctccgccctgctggagaatgcgtgtatttggcaatccccagcccctgtgccatctaaccatcttttcttctctgttcagcccaggtgtggcctcactcacatcccactctgagtccaaatgttctctccctggaagatatcaatgtttctgtctgttcgtgaggactccgtgcccaccacggcctctttcaggtgagtcaaagggattcctcagttcactagttaggggaggtgggcagacaccctggagaactccctggaaagctcaactctcatgccccggacaacagttgaaggaaccatggtgatgttaagcccaaagacaaaacctctcaggtgtccaagtccctgttggaatcttgggagcagagggaatgttctgtggtctagaggaagaggggctcagggaggagaagggcacattcctggttgttatatgtttctatctatcccagatgaacttggaagtgaagggaagagagttaaacattaaagtaaatacccagtggatcagacagcaatgtgccagattgccttggaaacaaaatatctccaacacatggctgacatttggtgggagatcagaacaccctaaagagagaatttaaggggagggggaggaggacctgagccagagtagaagcagaggatagggagatctgttcttggggacagcatttgcaagaaacaaggctgaggggtccactccaacctctccaccctgctgcaggtgctgcctatgatgaagatgagcagatggccatctcagctggggccacagtgcactggacctatagtttccaattccgcactcagcaggcatctttctgatgatccgatggcttctcagagccagggatgggccaggatccatccccttggctactgtcttgctgagaaatttataagcagcatctggtgctatactttggtctctagtgagttagctcatgaaagatgatagactctccaagccaggggtatgcaggaaatgggttttctgtagctacagaaatggggttgagggttggaccaagggactacccaggggaagtcttaccttcagaggactctggaaaggaggctgcaagttttcatgggtcaagaattcagagcccagtagagacagcttatctctgttccaagatgtctggggccttggttggaagattcaaaggctaggaaaccaggagccaccaaaagcgtaactggggccagaggatccactttcaaggtggcaagttggttccccccatgtggctgcttgagtatcctcacatggcggctcacatccttccaagtaagcaatgcaaaaggccaagaaagatgctgcaaagatgttatgacctagcctcagaaatcacacaccatccctgccaccattagtaagaagtccagcccacgtccaggagaagaggaagcagattcctccttttgaaatgaagaatatcaagtaattcggggggcatatgaaagccaccacacaccacagggatctttttagagcatacttcttataccatcactgtagttccttaagactcaggggcaaagcctcacttccttagcacccagtgaagaccacgcttactccctcactcaacctcttgctacttcccacctctcctgtccaacatctagtgtcactttccagaacataccaacagcttccccagttctgtgcctctgctcaggctgttccccctgcctggtccacttgtcctccttcttgtccggtcaaaatgcttcttatccttcaagacccagctctagagtcacctccaaccccttacccaccagccccctctccaagtctgtgtcccacaacccccctgctccctccagggcaccctccaccctctgggccacagttgtcaggagtcaggcagggcaggggccgggtggtgtcttctttgtgttcttgcactcagggcagagctcagcacagagcagacgctcaaaaaacatttaaaggatagaagcattgatttgtgggtcccccagtctggctccaggatgccagccagctgctcctagaagcaaacggacttttcctgggaaatcccagaggtgatgatcagtaatctctcccgtgactcgtagttcagctcttcctccatgagcctgactatcagtggaccttccagaaagagccccttttccttctctcacccacagcacagggcactgggaaaatgcccaatgagtcctgcctctgggttgtgctttggacttttcagtgtgtctcgcatccactcttcaacttgaatgttgcaacagccatgaaaaaagaaatgcaaagcgattcaggatgagagcaataccctactccaaagaaggcaacatagaagctcagagagatcaagcaatttgcccaagaccacacagctaggagtggaactcatggctgtccaagccccatgcctctgctgaaggtagagatgaattacagcaacaagtctagaaaggtgcctgccctatggtctgtgagtcttgcctaagaatgaaagaggagccagtgggttaaagatgaggtcaccaacaacggtggtgttggagtttaccactgataataagggtgcaaaatgtaaattactaatgtttattgagcctagtgcagtgcgtggggcattttgcacattgtctctgatccctatgacaaccctgagaggtagtggttttaactgccatgttacaggtgaggtcattgtggttcaaggacgttaagtaacttccccagcgtgacacggcttataagtaaggcagccaggatgtgaacccagtaggactatctggctgcaaagtccccacccccctcgccatctgtatcctccaatcacttcagtgctttgctgcatagaaggtaacggaaatcacgatgccacagactgtccaggaagacagaaactaggcagatgggctggccatggtctccaagccagactggaatctccaggtctggaatgatatcatttttctcttttaataaattaactcacccaccacacggctttgagaggctcaaagttgaccaactcccttgggagggccccggttgataaggaaggaacgtgaatcctcccatcacggaagcttcaaggaggtcaagggtccaacacttgagattgttagtgctgttggtggatactggccaaggaaatatcccagtggagcctcgagatgaagaacatgaggcccccgtttagaaccaaggatcagagggggctctgtaagacccaggggagtcaggtgcactggagcgcgggcatgcagaaaacagcctgagctccacctcggcttctccttgtcctggctggttgtccttaacccctgtctccttctggaccagtttttgtccttcccttgtgaccgctgaggggtaacagcctctttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgatgagacggtcgagcagggtgctgtgggtgatatggacagcagaagggggagccaggttccagctcaccaatactattgcacaccacctgtcctgcctcgcccttcaaagatgagctgttcccgccgccactccagctctggcttctgggctccgaggaggggtggggacggtggtgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgagctcttcaatattttagtgaaagctatagatgaggctccataggggataaagcacagacacaccttttcagagggcttgtggactctgggcagcctgtccatagacctctgtccccaactggcaagtcaggaaactccagattaaggagccccaatgtggttgaacagccaggtgcacagatgagtcaaccacacagccaggccagggagggccttcactcaagagcctacagccagttcacagccaagccagggctagcgccaggccacccataaactgatctgagactctgtttccctgtctccatgatgatgggatcaggcttgattgctggtttgtaggcttgttatgaatcaagtcacagggaagaggagctgatgggctggggggacgtcctctggccctcctgtctcttccccagatccactgggcccactcttatctgttctcttctgaaggaagggttttaaggcttcaaaaaaaaatgttttgaaagtccctgccctttccagctcctaccgtctcagccctgggagtgtaaagtgctgcagatagttagtaagtctttgagcaaaactgagaaagccagcctgagccttgacatgggagaaacctccgccatacatctccgaagaaacggccgcgtgtctcaggggagcgcaaacacccgtacccaggaaacaggacagcttctgccactgtcgcccttgggagccgtacgtggcatgacaaagaaatcccaggactccgcctgcccacctggccaccctctgtttacaccttccgcgtaaacgcccactgtttacatccaaaactcagacacaaaataaccacctcaagaagataaataatgataagaaataaatgttacgcgaggcaaatttattcacatggggcttcccaggccactttgtggtcagccgggagggacgtttttgccgtcccacgactccaacgggcagccgggcctacgcaaacatggaaatcttccaagagcctccctggcccccagggctcagagggtggcagagcggagagcgaaggtggccgcagccttcccggccccacagccagcctggctccagctgggcaggagtgcagagctcagctggaggcgagggggaagtgcccaggaggctgatgacatcactacccagcccttcaaagatgagctgttcccgccgccactccagctctggcttctgggctccgaggaggggtggggacggtggtgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgggaaaagttcccttccttccggagggaggcagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctggggggagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagacccaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccacctgtccctgcctcagttcccttttatgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaacctggagaggctagaaccaagaagggctagaacctggaggggctagaacctagagaagctaaaacctgagctagaagctggaggactagaacctggagggctggaatctgaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtgaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcaaaaaaaaaaaaaaaaaaaatgatagaccgtcaataatttgttaaatgctttttaaaatgaatgctttaagccgggtgcagtgcctcacatctgtaatcccagcactttggagccgagcgggtggattgtgtgaggtcaggagttcgagaccaacctggccaacatggcaaaacctcactctctaccaaaaatacaaaaattagccaggcatggtggcaggcacctgtgatcccagctactcaggaggctgagacaggagaatcgcttgaacccgggaggcaaggttgcagtgagccaagattacgccattgtactccagcctgggtgacagagagagactccgtctcaaaaaaaaaaaaaaaaaaaaaaaaattacgcttcaaacacatgatctctcaccactgttgaattttctttctatgagcccaggagggcctctcagagaggaaagctcctaggtcttcctttccctctgcaaactccctgccttgaaggttcagaaggactgtgcgtgctcgttgcatcctttgcaagtgtccaaaccctgatcccagctgtgcttaggggttcctgcaaaccttttccaggtgttaattacctcccacttcatttcctgtttaccaactcagctttttgttttagtgtgtttgaattccctgaactgaccgttgtctgatctccacctcccaactgaattaggggagctgggcttctggaaacccaggtgccgggtgttgcagagtggctgaaagctgggatgtggcagatccgtggctacattcatgcacacacacacacccacatacccacacatgcacacacacacacacacccgcactcacacacttggacatgcatagaccacagctttccacacccttcctagacaggggtcacttggtatcctggagagagtgtgaagtcctggaatggaaagaggggggattaagccccacctctagccatgggactgagacaagtcaccaccaacccatctgcgccttgtttacctcctctgtgaggcaagcacagagcccatgcctgcccccctggatgggagtgatgtgaaacttgaagggcggtcagagcaagggtcgggaatggaaggcccttgggaaaaaaggccctttcaactaggggcacagaggaggccctgggctgagaacttgacagcaccttgtaattggtaagccaagcccgaagggactggaaatactcagatgtgtctgtctcccttattaggttcaaagtccctcaagaccctgtctccatcacagtgctccagtccagacccctcctctgagctccagaccctgctggacccaaccagccctatggggtcgcatccccacctgcctggaattctccaaagaacctcccctttaacagttccagcctttaacagttccagtctaaacacatgacctttctcctctaaatcagccccccatctctgcctttgcaggagatggaagccatgacacctgcctcgcccctgtcctcaccccatccatgtccaatcaagcactaggcatgtcaggtttaccctctaaactcctctggaatccagtctctcagtctccatcatcccaggtcgaagctaatgggctaactggtccttgcttccactctacccccactgcagtcctgacttcctgagcagcagccagggcctaatcgatattcacaccaagcgccaacctgactgagatatcctcctgcaccatcatccctccaccctgtttagttctgctcaccctcagtgttctcatcaataatccactcccctcacaggcgcgtttgggaccccatgttctatgctctcacaggaccttttgcttgatttttcactgtacttaggtcagtttgcagttattaagtgactgagcaatgtctggcttctccagtagactgtcagctcctagccattgtatacctagcaccgctgtgtgggagcacgtgacaaacgtccagtgagtcagggactcagcagtctccatttctccgccctgctggagaatgcgtgtatttggcaatccccagcccctgtgccatctaaccatcttttcttctctgttcagcccaggtgtggcctcactcacatcccactctgagtccaaatgttctctccctggaagatatcaatgtttctgtctgttcgtgaggactccgtgcccaccacggcctctttcaggtgagtcaaagggattcctcagttcactagttaggggaggtgggcagacaccctggagaactccctggaaagctcaactctcatgccccggacaacagttgaaggaaccatggtgatgttaagcccaaagacaaaacctctcaggtgtccaagtccctgttggaatcttgggagcagagggaatgttctgtggtctagaggaagaggggctcagggaggagaagggcacattcctggttgttatatgtttctatctatcccagatgaacttggaagtgaagggaagagagttaaacattaaagtaaatacccagtggatcagacagcaatgtgccagattgccttggaaacaaaatatctccaacacatggctgacatttggtgggagatcagaacaccctaaagagagaatttaaggggagggggaggaggacctgagccagagtagaagcagaggatagggagatctgttcttggggacagcatttgcaagaaacaaggctgaggggtccactccaacctctccaccctgctgcaggtgctgcctatgatgaagatgagcagatggccatctcagctggggccacagtgcactggacctatagtttccaattccgcactcagcaggcatctttctgatgatccgatggcttctcagagccagggatgggccaggatccatccccttggctactgtcttgctgagaaatttataagcagcatctggtgctatactttggtctctagtgagttagctcatgaaagatgatagactctccaagccaggggtatgcaggaaatgggttttctgtagctacagaaatggggttgagggttggaccaagggactacccaggggaagtcttaccttcagaggactctggaaaggaggctgcaagttttcatgggtcaagaattcagagcccagtagagacagcttatctctgttccaagatgtctggggccttggttggaagattcaaaggctaggaaaccaggagccaccaaaagcgtaactggggccagaggatccactttcaaggtggcaagttggttccccccatgtggctgcttgagtatcctcacatggcggctcacatccttccaagtaagcaatgcaaaaggccaagaaagatgctgcaaagatgttatgacctagcctcagaaatcacacaccatccctgccaccattagtaagaagtccagcccacgtccaggagaagaggaagcagattcctccttttgaaatgaagaatatcaagtaattcggggggcatatgaaagccaccacacaccacagggatctttttagagcatacttcttataccatcactgtagttccttaagactcaggggcaaagcctcacttccttagcacccagtgaagaccacgcttactccctcactcaacctcttgctacttcccacctctcctgtccaacatctagtgtcactttccagaacataccaacagcttccccagttctgtgcctctgctcaggctgttccccctgcctggtccacttgtcctccttcttgtccggtcaaaatgcttcttatccttcaagacccagctctagagtcacctccaaccccttacccaccagccccctctccaagtctgtgtcccacaacccccctgctccctccagggcaccctccaccctctgggccacagttgtcaggagtcaggcagggcaggggccgggtggtgtcttctttgtgttcttgcactcagggcagagctcagcacagagcagacgctcaaaaaacatttaaaggatagaagcattgatttgtgggtcccccagtctggctccaggatgccagccagctgctcctagaagcaaacggacttttcctgggaaatcccagaggtgatgatcagtaatctctcccgtgactcgtagttcagctcttcctccatgagcctgactatcagtggaccttccagaaagagccccttttccttctctcacccacagcacagggcactgggaaaatgcccaatgagtcctgcctctgggttgtgctttggacttttcagtgtgtctcgcatccactcttcaacttgaatgttgcaacagccatgaaaaaagaaatgcaaagcgattcaggatgagagcaataccctactccaaagaaggcaacatagaagctcagagagatcaagcaatttgcccaagaccacacagctaggagtggaactcatggctgtccaagccccatgcctctgctgaaggtagagatgaattacagcaacaagtctagaaaggtgcctgccctatggtctgtgagtcttgcctaagaatgaaagaggagccagtgggttaaagatgaggtcaccaacaacggtggtgttggagtttaccactgataataagggtgcaaaatgtaaattactaatgtttattgagcctagtgcagtgcgtggggcattttgcacattgtctctgatccctatgacaaccctgagaggtagtggttttaactgccatgttacaggtgaggtcattgtggttcaaggacgttaagtaacttccccagcgtgacacggcttataagtaaggcagccaggatgtgaacccagtaggactatctggctgcaaagtccccacccccctcgccatctgtatcctccaatcacttcagtgctttgctgcatagaaggtaacggaaatcacgatgccacagactgtccaggaagacagaaactaggcagatgggctggccatggtctccaagccagactggaatctccaggtctggaatgatatcatttttctcttttaataaattaactcacccaccacacggctttgagaggctcaaagttgaccaactcccttgggagggccccggttgataaggaaggaacgtgaatcctcccatcacggaagcttcaaggaggtcaagggtccaacacttgagattgttagtgctgttggtggatactggccaaggaaatatcccagtggagcctcgagatgaagaacatgaggcccccgtttagaaccaaggatcagagggggctctgtaagacccaggggagtcaggtgcactggagcgcgggcatgcagaaaacagcctgagctccacctcggcttctccttgtcctggctggttgtccttaacccctgtctccttctggaccagtttttgtccttcccttgtgaccgctgaggggtaacagcctctttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgatgagacggtcgagcagggtgctgtgggtgatatggacagcagaagggggagccaggttccagctcaccaatactattgcacaccacctgtcctgcctcctgcagaaaacagcctgagctccacctcggcttctccttgccctggctggttgtccttaacccctgtctccttctggaccagtttttgtccttcccttgtgaccctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgncctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaagggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactggcactgccaccaccagaaagctgttcgacgagacggtcgagcagggtgctgtgggtgatatggacagcagaagggggagaccaaggttccagctcaaccaataactattgcacaaccacctgtccctgcctcagttccctcttctgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagatgatcctatcacaacctgagagtagtttttactccatttacaggtgaggtcattgtggttcaaggacgttaagtaacttccccagctcacacggcttataagtaaggcagccaggatgtgaacccagtaggactatctggctgcaaagtccccaccctccctcgccatctgtatcctccaatcatcttcagtgctttgctgatagaaggtacggaaatacgatgccacagactgtccaggaagacagaaactaggcagatgggctggccatggtctccaagccagactggaatctccaggtctggaatgatatcatttttctcttttaataaattaactcacccaccacacggctttgagaggctcaaaggtgaccaactcccttgggagggccccggttgataaggaaggaatgtgaatcctcccatcacggaagcttcaaggaggtcaagggtccaacacttgagattgttagtgctgttggtggatactgcagaatatccagtggagcctcagatgaagaacatgaggccccgtttagatccaaggatcagagggggctctgtaagacccaggggagtcaggtgcactggagcgcgggctgcagaaaacagcctgagctccacctcggcttctccttgccctggctggttgtccttaacccctgtctccttctggaccagtttttgtccttcccttgtgacctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagtgttgatgtctccggtaaaacaccggagactaattcctgccctgcccaattttcgagggagcatggctgtgaggatggggtgaactcacgcacagccaaggactccaaaatcacaacagcattactgttcttatttgctgccacacctgagccagcctgctccttcccaggagtggaggaggcctgggggagggagaggagtgactgagcttccctcccgtgtgttctccgtccctgccccagcaagacaacttagatctccaggagaactgccatccacgtttggtgcaatggctgagtgcacaagtgagttgttgccctgggtttctttaatctatcagctagaactttgaaggacaatttcttgcattaataaaggttaagccctgaggggtcccttgataacaacctggagaccaggattttatggctcccctcactgatggacaaggaggtctgtgccaaagaagaatcaataagcacatatgagcacttctgtatatcagtattgagcactgtaggcaatgttctctccctggaagatatcaatgtttctgtctgtttgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttatgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttgcccttcaaagatgagctgttcccgccgccactccagctctggcttctgggctccgaggaggggtggggacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgcccttcaaagatgagctgttcccgccgccactccagctctggcttctgggctccgaggaggggtggggacggtggtgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgagctcttcaatattttagtgaaagctatagatgaggctccataggggataaagcacagacacaccttttcagagggcttgtggactctgggcagcctgtccatagacctctgtccccaactggcaagtcaggaaactccagattaaggagccccaatgtggttgaacagccaggtgcacagatgagtcaaccacacagccaggccagggagggccttcactcaagagcctacagccagttcacagccaagccagggctagcgccaggccacccataaactgatctgagactctgtttccctgtctccatgatgatgggatcaggcttgattgctggtttgtaggcttgttatgaatcaagtcacagggaagaggagctgatgggctggggggacgtcctctggccctcctgtctcttccccagatccactgggcccactcttatctgttctcttctgaaggaagggttttaaggcttcaaaaaaaaatgttttgaaagtccctgccctttccagctcctaccgtctcagccctgggagtgtaaagtgctgcagatagttagtaagtctttgagcaaaactgagaaagccagcctgagccttgacatgggagaaacctccgccatacatctccgaagaaacggccgcgtgtctcaggggagcgcaaacacccgtacccaggaaacaggacagcttctgccactgtcgcccttgggagccgtacgtggcatgacaaagaaatcccaggactccgcctgcccacctggccaccctctgtttacaccttccgcgtaaacgcccactgtttacatccaaaactcagacacaaaataaccacctcaagaagataaataatgataagaaataaatgttacgcgaggcaaatttattcacatggggcttcccaggccactttgtggtcagccgggagggacgtttttgccgtcccacgactccaacgggcagccgggcctacgcaaacatggaaatcttccaagagcctccctggcccccagggctcagagggtggcagagcggagagcgaaggtggccgcagccttcccggccccacagccagcctggctccagctgggcaggagtgcagagctcagctggaggcgagggggaagtgcccaggaggctgatgacatcactacccagcccttcaaagatgagctgttcccgccgccactccagctctggcttctgggctccgaggaggggtggggacggtggtgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgggaaaagttcccttccttccggagggaggcagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctggggggagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagacccaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccacctgtccctgcctcagttcccttttatgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaacctggagaggctagaaccaagaagggctagaacctggaggggctagaacctagagaagctaaaacctgagctagaagctggaggactagaacctggagggctggaatctgaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtgaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcaaaaaaaaaaaaaaaaaaaatgatagaccgtcaataatttgttaaatgctttttaaaatgaatgctttaagccgggtgcagtgcctcacatctgtaatcccagcactttggagccgagcgggtggattgtgtgaggtcaggagttcgagaccaacctggccaacatggcaaaacctcactctctaccaaaaatacaaaaattagccaggcatggtggcaggcacctgtgatcccagctactcaggaggctgagacaggagaatcgcttgaacccgggaggcaaggttgcagtgagccaagattacgccattgtactccagcctgggtgacagagagagactccgtctcaaaaaaaaaaaaaaaaaaaaaaaaattacgcttcaaacacatgatctctcaccactgttgaattttctttctatgagcccaggagggcctctcagagaggaaagctcctaggtcttcctttccctctgcaaactccctgccttgaaggttcagaaggactgtgcgtgctcgttgcatcctttgcaagtgtccaaaccctgatcccagctgtgcttaggggttcctgcaaaccttttccaggtgttaattacctcccacttcatttcctgtttaccaactcagctttttgttttagtgtgtttgaattccctgaactgaccgttgtctgatctccacctcccaactgaattaggggagctgggcttctggaaacccaggtgccgggtgttgcagagtggctgaaagctgggatgtggcagatccgtggctacattcatgcacacacacacacccacatacccacacatgcacacacacacacacacccgcactcacacacttggacatgcatagaccacagctttccacacccttcctagacaggggtcacttggtatcctggagagagtgtgaagtcctggaatggaaagaggggggattaagccccacctctagccatgggactgagacaagtcaccaccaacccatctgcgccttgtttacctcctctgtgaggcaagcacagagcccatgcctgcccccctggatgggagtgatgtgaaacttgaagggcggtcagagcaagggtcgggaatggaaggcccttgggaaaaaaggccctttcaactaggggcacagaggaggccctgggctgagaacttgacagcaccttgtaattggtaagccaagcccgaagggactggaaatactcagatgtgtctgtctcccttattaggttcaaagtccctcaagaccctgtctccatcacagtgctccagtccagacccctcctctgagctccagaccctgctggacccaaccagccctatggggtcgcatccccacctgcctggaattctccaaagaacctcccctttaacagttccagcctttaacagttccagtctaaacacatgacctttctcctctaaatcagccccccatctctgcctttgcaggagatggaagccatgacacctgcctcgcccctgtcctcaccccatccatgtccaatcaagcactaggcatgtcaggtttaccctctaaactcctctggaatccagtctctcagtctccatcatcccaggtcgaagctaatgggctaactggtccttgcttccactctacccccactgcagtcctgacttcctgagcagcagccagggcctaatcgatattcacaccaagcgccaacctgactgagatatcctcctgcaccatcatccctccaccctgtttagttctgctcaccctcagtgttctcatcaataatccactcccctcacaggcgcgtttgggaccccatgttctatgctctcacaggaccttttgcttgatttttcactgtacttaggtcagtttgcagttattaagtgactgagcaatgtctggcttctccagtagactgtcagctcctagccattgtatacctagcaccgctgtgtgggagcacgtgacaaacgtccagtgagtcagggactcagcagtctccatttctccgccctgctggagaatgcgtgtatttggcaatccccagcccctgtgccatctaaccatcttttcttctctgttcagcccaggtgtggcctcactcacatcccactctgagtccaaatgttctctccctggaagatatcaatgtttctgtctgttcgtgaggactccgtgcccaccacggcctctttcaggtgagtcaaagggattcctcagttcactagttaggggaggtgggcagacaccctggagaactccctggaaagctcaactctcatgccccggacaacagttgaaggaaccatggtgatgttaagcccaaagacaaaacctctcaggtgtccaagtccctgttggaatcttgggagcagagggaatgttctgtggtctagaggaagaggggctcagggaggagaagggcacattcctggttgttatatgtttctatctatcccagatgaacttggaagtgaagggaagagagttaaacattaaagtaaatacccagtggatcagacagcaatgtgccagattgccttggaaacaaaatatctccaacacatggctgacatttggtgggagatcagaacaccctaaagagagaatttaaggggagggggaggaggacctgagccagagtagaagcagaggatagggagatctgttcttggggacagcatttgcaagaaacaaggctgaggggtccactccaacctctccaccctgctgcaggtgctgcctatgatgaagatgagcagatggccatctcagctggggccacagtgcactggacctatagtttccaattccgcactcagcaggcatctttctgatgatccgatggcttctcagagccagggatgggccaggatccatccccttggctactgtcttgctgagaaatttataagcagcatctggtgctatactttggtctctagtgagttagctcatgaaagatgatagactctccaagccaggggtatgcaggaaatgggttttctgtagctacagaaatggggttgagggttggaccaagggactacccaggggaagtcttaccttcagaggactctggaaaggaggctgcaagttttcatgggtcaagaattcagagcccagtagagacagcttatctctgttccaagatgtctggggccttggttggaagattcaaaggctaggaaaccaggagccaccaaaagcgtaactggggccagaggatccactttcaaggtggcaagttggttccccccatgtggctgcttgagtatcctcacatggcggctcacatccttccaagtaagcaatgcaaaaggccaagaaagatgctgcaaagatgttatgacctagcctcagaaatcacacaccatccctgccaccattagtaagaagtccagcccacgtccaggagaagaggaagcagattcctccttttgaaatgaagaatatcaagtaattcggggggcatatgaaagccaccacacaccacagggatctttttagagcatacttcttataccatcactgtagttccttaagactcaggggcaaagcctcacttccttagcacccagtgaagaccacgcttactccctcactcaacctcttgctacttcccacctctcctgtccaacatctagtgtcactttccagaacataccaacagcttccccagttctgtgcctctgctcaggctgttccccctgcctggtccacttgtcctccttcttgtccggtcaaaatgcttcttatccttcaagacccagctctagagtcacctccaaccccttacccaccagccccctctccaagtctgtgtcccacaacccccctgctccctccagggcaccctccaccctctgggccacagttgtcaggagtcaggcagggcaggggccgggtggtgtcttctttgtgttcttgcactcagggcagagctcagcacagagcagacgctcaaaaaacatttaaaggatagaagcattgatttgtgggtcccccagtctggctccaggatgccagccagctgctcctagaagcaaacggacttttcctgggaaatcccagaggtgatgatcagtaatctctcccgtgactcgtagttcagctcttcctccatgagcctgactatcagtggaccttccagaaagagccccttttccttctctcacccacagcacagggcactgggaaaatgcccaatgagtcctgcctctgggttgtgctttggacttttcagtgtgtctcgcatccactcttcaacttgaatgttgcaacagccatgaaaaaagaaatgcaaagcgattcaggatgagagcaataccctactccaaagaaggcaacatagaagctcagagagatcaagcaatttgcccaagaccacacagctaggagtggaactcatggctgtccaagccccatgcctctgctgaaggtagagatgaattacagcaacaagtctagaaaggtgcctgccctatggtctgtgagtcttgcctaagaatgaaagaggagccagtgggttaaagatgaggtcaccaacaacggtggtgttggagtttaccactgataataagggtgcaaaatgtaaattactaatgtttattgagcctagtgcagtgcgtggggcattttgcacattgtctctgatccctatgacaaccctgagaggtagtggttttaactgccatgttacaggtgaggtcattgtggttcaaggacgttaagtaacttccccagcgtgacacggcttataagtaaggcagccaggatgtgaacccagtaggactatctggctgcaaagtccccacccccctcgccatctgtatcctccaatcacttcagtgctttgctgcatagaaggtaacggaaatcacgatgccacagactgtccaggaagacagaaactaggcagatgggctggccatggtctccaagccagactggaatctccaggtctggaatgatatcatttttctcttttaataaattaactcacccaccacacggctttgagaggctcaaagttgaccaactcccttgggagggccccggttgataaggaaggaacgtgaatcctcccatcacggaagcttcaaggaggtcaagggtccaacacttgagattgttagtgctgttggtggatactggccaaggaaatatcccagtggagcctcgagatgaagaacatgaggcccccgtttagaaccaaggatcagagggggctctgtaagacccaggggagtcaggtgcactggagcgcgggcatgcagaaaacagcctgagctccacctcggcttctccttgtcctggctggttgtccttaacccctgtctccttctggaccagtttttgtccttcccttgtgaccgctgaggggtaacagcctctttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgatgagacggtcgagcagggtgctgtgggtgatatggacagcagaagggggagccaggttccagctcaccaatactattgcacaccacctgtcctgcctcctgcagaaaacagcctgagctccacctcggcttctccttgccctggctggttgtccttaacccctgtctccttctggaccagtttttgtccttcccttgtgaccctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgncctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaagggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactggcactgccaccaccagaaagctgttcgacgagacggtcgagcagggtgctgtgggtgatatggacagcagaagggggagaccaaggttccagctcaaccaataactattgcacaaccacctgtccctgcctcagttccctcttctgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagatgatcctatcacaacctgagagtagtttttactccatttacaggtgaggtcattgtggttcaaggacgttaagtaacttccccagctcacacggcttataagtaaggcagccaggatgtgaacccagtaggactatctggctgcaaagtccccaccctccctcgccatctgtatcctccaatcatcttcagtgctttgctgatagaaggtacggaaatacgatgccacagactgtccaggaagacagaaactaggcagatgggctggccatggtctccaagccagactggaatctccaggtctggaatgatatcatttttctcttttaataaattaactcacccaccacacggctttgagaggctcaaaggtgaccaactcccttgggagggccccggttgataaggaaggaatgtgaatcctcccatcacggaagcttcaaggaggtcaagggtccaacacttgagattgttagtgctgttggtggatactgcagaatatccagtggagcctcagatgaagaacatgaggccccgtttagatccaaggatcagagggggctctgtaagacccaggggagtcaggtgcactggagcgcgggctgcagaaaacagcctgagctccacctcggcttctccttgccctggctggttgtccttaacccctgtctccttctggaccagtttttgtccttcccttgtgacctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagtgttgatgtctccggtaaaacaccggagactaattcctgccctgcccaattttcgagggagcatggctgtgaggatggggtgaactcacgcacagccaaggactccaaaatcacaacagcattactgttcttatttgctgccacacctgagccagcctgctccttcccaggagtggaggaggcctgggggagggagaggagtgactgagcttccctcccgtgtgttctccgtccctgccccagcaagacaacttagatctccaggagaactgccatccacgtttggtgcaatggctgagtgcacaagtgagttgttgccctgggtttctttaatctatcagctagaactttgaaggacaatttcttgcattaataaaggttaagccctgaggggtcccttgataacaacctggagaccaggattttatggctcccctcactgatggacaaggaggtctgtgccaaagaagaatcaataagcacatatgagcacttctgtatatcagtattgagcactgtaggcaatgttctctccctggaagatatcaatgtttctgtctgtttgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttatgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttgcccttcaaagatgagctgttcccgccgccactccagctctggcttctgggctccgaggaggggtggggacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgcccttcaaagatgagctgttcccgccgccactccagctctggcttctgggctccgaggaggggtggggacggtggtgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgagctcttcaatattttagtgaaagctatagatgaggctccataggggataaagcacagacacaccttttcagagggcttgtggactctgggcagcctgtccatagacctctgtccccaactggcaagtcaggaaactccagattaaggagccccaatgtggttgaacagccaggtgcacagatgagtcaaccacacagccaggccagggagggccttcactcaagagcctacagccagttcacagccaagccagggctagcgccaggccacccataaactgatctgagactctgtttccctgtctccatgatgatgggatcaggcttgattgctggtttgtaggcttgttatgaatcaagtcacagggaagaggagctgatgggctggggggacgtcctctggccctcctgtctcttccccagatccactgggcccactcttatctgttctcttctgaaggaagggttttaaggcttcaaaaaaaaatgttttgaaagtccctgccctttccagctcctaccgtctcagccctgggagtgtaaagtgctgcagatagttagtaagtctttgagcaaaactgagaaagccagcctgagccttgacatgggagaaacctccgccatacatctccgaagaaacggccgcgtgtctcaggggagcgcaaacacccgtacccaggaaacaggacagcttctgccactgtcgcccttgggagccgtacgtggcatgacaaagaaatcccaggactccgcctgcccacctggccaccctctgtttacaccttccgcgtaaacgcccactgtttacatccaaaactcagacacaaaataaccacctcaagaagataaataatgataagaaataaatgttacgcgaggcaaatttattcacatggggcttcccaggccactttgtggtcagccgggagggacgtttttgccgtcccacgactccaacgggcagccgggcctacgcaaacatggaaatcttccaagagcctccctggcccccagggctcagagggtggcagagcggagagcgaaggtggccgcagccttcccggccccacagccagcctggctccagctgggcaggagtgcagagctcagctggaggcgagggggaagtgcccaggaggctgatgacatcactacccagcccttcaaagatgagctgttcccgccgccactccagctctggcttctgggctccgaggaggggtggggacggtggtgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgggaaaagttcccttccttccggagggagggaattcgggaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtatcccgaattcgccaccatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgcctccatctggatcctgtcctttatcctggccattcctgaagcgattggcttcgtcatggtaccctttgaatataggggtggacagcataaaacctgtatgctcaatgccacatcaaaattcatggagttctaccaagatgtaaaggactggtggctcttcgggttctatttctgtatgcccttggtgtgcactgcgatcttctacaccctcatgactggtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctgaattcgggaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtatcccgaattcaacaagaaaagcgttggtagctctggtgaatcccaaaagaatgtggcagttgctagccatgctcctgaatatgtataaacagtacatcatatgactaagagtttgacttaggggttagattttatgtgtttgaaccccaaattagttatttaatagttggcaccccaaaacaagttacttaacctcactaaggttcagttttcctgtttataaaatgtagatagtgatagtatgtactttataggattattgtgaaaaataaatgaaatatcagatttatttaggataacacctggcatatgtttggtattcagaattagttgctgctgttttattctgctctcccttgcatcccacttttctaagttgtaaactaaatagttgtacacagattgacagattaagaaaggcttgtgattgtgctagacctatgcctatgcctctgtctcaccagattccaggtgtatatgtggaggtgggatagggagtggagtaagtgggtaaatattaaattgcccagttgggcaccatcctgaatattatctctaaagaaagaagcaaaaccaggcacagctgatgggttaaccagatatgatacagaaaacatttccttctgctttttggttttaagcctatatttgaagccttagatctctccagcacagtaagcaccaggagtccatgaagaagatggatcttcatgtggaatgactggtttcattcaatagacttaattcagcagtctgtggggaagagcaaggtatgatagaatggttcctcaagtgcttcagatgtgaagtgggtttaaatatactgtccctgtcttcttcagagttttggtaaagataaaataggacactcatttaaaagcaatctttgcaaatgacaagccactatagacattaatagagttttcatttccagtattatcattaatatcagatcctggaagaaggttgagccttgacctagagcaaaaaaacagaagaattagtaaaggaatcctggagaaagcccctgctgtgtatttaaaggagaaagggagatcatgttgggaaattataatattaaaagtaaacaaaagctaggaagtaaaataaaataaattatatggcctagatccccataagtaatggtttaacttctgccttcctgtgttctgagccagattagggcacagtagagaaagaggagtctctgaaaatgtttccaatttcgctggtcagacagcggatcatcagtgaatcagatgaaaatttgtggatttatgcactaactgatcagcaggaaattaaacaagaaaagcgttggtagctctggtgaatcccaaaagaatttggcagttgctagccatgctcctgaatatgtataaacagtacatcatatgactaagagtttgacttaggggttagattttatgtgtttgaaccccaaattagttatttaatagttggcaccccaaaacaagttacttaacctcactaagattcagttttcctgtttataaaatgtagatagtgatagtatgtactttataggattattgtgaaaaataaatgaaatatcagatttatttaggataacacctggcatatgtttggtattcagtaattagttgctgctgttttattctgctctcccttgcatcccacttttctaagttgtaaactaaatagttgtacacagattgacagattaagaaaggcttgtgattgtgctagacctatgcctctctctcaccagattccaggtgtatatgtggaggtgggatagggagtggagtaagtgggtaaatattaaattgcccagttgggcaccatcctgaatattatctctaaagaaagaagcaaaaccaggcacagctgatgggttaaccagatatgatacagaaaacatttccttctgctttttggttttaagcctatatttgaagccttagatctctccagcacagtaagcaccaggagtccatgaagaagatggctcctgccatggaatcccctactctactgtgtgtagccttactgttcttcggtaagtagagattcaattacccctcccagggaggcccaaatgaatttggggagcagctggggtaggaacctttactgtgggtggtgactttttctaggacatgtgcaaactattgggcatttcccagggactctgtagtggagccaagctagaaagcagaggcaagtgggctgagcaacacctaaggaggaagccagactgaaagcttggttccttgcatttgctctggcatcttccagagtgcaaatttcctaccaaggtaatgagggtagaggagagaaagaagctctttcttcccctgattctcattcctgaaaagacggttggtccttaaaattccatggatgtagatcttatccccacacccagattctagtcctctggagataaagaagactgctggacactaatgtatcctctctggacttttgcagctccagatggcgtgttagcaggtgagtcctctgttcttgttcccttggtgtatcaacatgtctgggcattgctttcctctcactattttcttcgtcccatcacttctgctttctaatgagcatgaatctgttccttggccagactactttccctctccaccttgccttgtctttctttttttccctgattcattgcattctctcaagtcattctctcctctgttttagtcaataaccatgtctgttgcacatatacatgtctcattctctctcctagacactttggcatgatctcgctcaataattacattattattattattgccattttataattgaggatgctgaaactcagtgattttctggtggttacatggctaaggaactggatttcaacgtaagttccttggatctaagtccagttctcttctgactatatcacccttttgttatcaccatgtatctacttctttggtctctgttcaaatttgcactacatccccttgttccaggaagccattcaagactgactttcttagtgcctctcactactttctggaactgacatatgtttttcactctgtatatacttacaattaaatagtcataaatattcagagcttggagaaaccttatatttcatccagtccagtaaatttatccatccataattcactcattcattcacataataaatatttaatgtaacaatggttgaacatggcagacagtgtttctacctcaaaagagattgcagtcctcatttacagatactgaattgaaattaacagaagtagagtgagtcagctcaaatcacatagtgaattggtttctttgtttttaaatctcctgcatatgtgtcctgtctttctccctgtgttgggcgttccctggggcaccaatactaatttctccttcccctagaaatcaaaacagggtcttatcaccaacagaataaggacaggttgaccactgattgtcagaatattgcttcgtttgtacttttaagcctagacagttttcaatgactttttttctctctacatgtcttttcatatttttatcttcttgaagtccctcagaaacctaaggtctccttgaaccctccatggaatagaatatttaaaggagagaatgtgactcttacatgtaatgggaacaatttctttgaagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtggtaagttccagggatatggaaatacagatctctcatgtgagggatggctcatctgaagatgggaaaaaacaggttattccaagggttaggacaccagagtgggattcaaggcctctcatttttaagacccctgcattggctgggcacagtggctcacgcctgtaatcccagcactttgggaggctgaggcaggtggatcacgaggtcaggagatcgagaccatccggctaacatggtgaaaccccatctctgctaaaaaatatatatatataaaattagccgggcgtagtggtgggcacctgtagtcccaggtactcgggaggctgaggcaggagaatggtgtgaacccaggaggtggaggttgcagtgagctgagatcacgccactgccctccagcctgggctacagagcaagactccgtctcaaaaaataaataaataaataaaaaagacccctgcatctcttttcttctacccccttcccttttgattacttgtatgccttctttcaatattctagtcatctctcaatattattcctccaccctattttcctctatcttttctgcctagattcaggtatatattatgtggtcaaacagcatgacatatatgtgaacatttcaaagagctgtgtatctggaataggatcaaaaggtttgacttaaagttttgctctgcataatccatatggcaggacctgaatattaggttgtactcttcgttatgaaacatatctgggtacatttccttatgtcctctgttgttacttaagaacacatatttcatgcttgtttcatttttatcactcctactgccaacaaatagcatagcatgcttaggcacatgtggcttaattagcaaatgttgaataaacaaattaatgattttgaatagtgaccaataggtctcttttatactctatatttttctcttgagtgaaaaaaaatgtttcaacctccatatgtaaattccaaacacaaactaaagcaatgtagaatagcttctttattccctggagtaggttctagagaagtcctaaaggattggtcctaaattaattatgcttattatgctagcgatatttcctttcaaaattctcctttaatgaatgctttttaatttttacaaaagcattaaccatagaatgtgattcttgtctttcactgactcattagtgacaaatatttgttgagtacctaccaactcctaagtattgctaccaactcctaaatactgtgttgggcattcagaatagaatgtagaactagacagggtccctgacttcttggagcacagagcagtatgggaagaggacattaaataaagaattacataagtaattaatttaaattatacatgttttgaagaagtttttttttgacaactataattaacactagaactgggaagtttctataaggtaagagaggacaaaatagacactctcctaagctaaaattcccaagaaagactgtttattttcccctaactaactagaactagcaacagaagatctgaaaggaattctggctttcaagtgttccatgtatggactcatcagggaggtccgagaggctttgtggccccagactgacttttcaggaggggaaaggatttatcaatacacaagacaggctctaagcattattttgtgccctttaaaaatccactttatgagccaaaaagtgagttaatgataattcatagtttctgacacatgctctatgcgtggctctcttttctctattcattctctctctcttcatttattgttaaataaataatgtaatgaatgttcttcagactggctgctccttcaggcctctgctgaggtggtgatggagggccagcccctcttcctcaggtgccatggttggaggaactgggatgtgtacaaggtgatctattataaggatggtgaagctctcaagtactggtatgagaaccacaacatctccattacaaatgccacagttgaagacagtggaacctactactgtacgggcaaagtgtggcagctggactatgagtctgagcccctcaacattactgtaataaaaggtgagttggtaaaggaaaggaaaagcatccatagcaggggaaggaagagagaacttctgagcctgagcagttgcagcttgtagaaggggggcacctgtgatacactggaaagcctaccagacttgcaatgaggagacctgggtgatagtatatatctcaatctctgtttcaaagccttgacttgttaaatggtgatagtaatacctgcttgcactatgaaatttttatgaagattaatgtggtaatatttgtgaaatgactttgtaaactgttaagcactacccaagcataacagattgtgattactattttgatctcaaagtcatctgttgctcctgggggaacacttatatttatcaaattgaaaaaaagtttcaaagttgaatgaagaaaggatataaagagcttgaggagcccattccagcttaggagggctgggaaaggaaaccagcaagtcagtaagctgtgtgcctgtgtattgagggaggagggaatggacttgatatggagagggtagggaggtggactgcctctatggcctgtaagaaaaactgctctctccaaactctttataagagagggagcctgtgaagtattcacttttgaaggagaaagttagacttttccttcacacactttgtacataataatgtttaaaaaagcatgaggtcaaaatacataattaagtcctagcagttctctgttaactaatttgagactgaagtgctatgtacttgtctctaggcttccagtatcttcatctgtaaaacagaatatttggtctagattccattagaatcatttgataacttaaaaaatatattgatgctcatgtctcatttcttgagattctgatttaattggtttggggtgcagcctgggtatacgtatttttcataggtctttcacataatggtaatgggtagccaatattgagaatcacttgtctaggtgatctttaaatgatttctggatgtaatattctgaggctctataatttgagactaatcacaaaaatcggtacagtttataaacagactaacagaaccacaaaataatagaattggaaggcaatttaactagtgcaatttcttcattttgcctaacaggcatgtaagaaatgatgattgattgagtaataggcattgatgacccctgtcctcactttgtcccctttccaccccttaattatatgtgaattctggtcttgtcatttcgaataaggggtttatctttcctattgtcttcccctctgggcacggcacactggctactggagttaagaggaaatgcttaggactccctgtggctccagggagcaccaacagagcaactcaacctagtgttaatctgagtgttttctctgtgcttctggatgccacatcacgctaaaaatgaaggacaaagcttggtctttctcttagggaggatgaaactctgaacctcatttttcagttcccaagatgaattatgtttctcattgcatctgtgttccactacagctccgcgtgagaagtactggctacaattttttatcccattgttggtggtgattctgtttgctgtggacacaggattatttatctcaactcagcagcaggtcacatttctcttgaagattaagagaaccaggaaaggcttcagacttctgaacccacatcctaagccaaaccccaaaaacaactgatataattactcaagaaatatttgcaacattagtttttttccagcatcagcaattgctactcaattgtcaaacacagcttgcaatatacatagaaacgtctgtgctcaaggatttatagaaatgcttcattaaactgagtgaaactggttaagtggcatgtaatagtaagtgctcaattaacattggttgaataaatgagagaatgaatagattcatttattagcatttgtaaaagagatgttcaatttcaataaaataaatataaaaccatgtaacagaatgcttctgagtattcaaggcttgctagtttgtttgtttgttttctactaaaggcaaggaccatgaagttctagattggaaatgtcctctcttgactattgcaagtgcgatctaggaatgaaaagacataggaggatgccagtgaggtggatcatttttatgcttcttcttcagcttactaaatatgaactttcagttcttggcagaatcagggacagtctcaagacataggactctcaggatgaagtagagtccaggattcctctgtgattgttttgcccctcccaaatttatatcttgaacttatgtcttgtatctttatacagcacctgaaccaagcattttggagaaattccagctaataataataaccaaaaccttcggctctgaaaacagtccaggactgaataagatcttgggcaaaagaactagacagttttggtttattttccctttcattttatgtcttcatcatagtcattggaggctcattcttcttgtcatggagtaaatgggattaaagttctactaagagtctccagcatcctccacctgtctaccaccgagcatgggcctatatttgaagccttagatctctccagcacagtaagcaccaggagtccatgaagaagatggctcctgccatggaatcccctactctactgtgtgtagccttactgttcttcgctccagatggcgtgttagcagtccctcagaaacctaaggtctccttgaaccctccatggaatagaatatttaaaggagagaatgtgactcttacatgtaatgggaacaatttctttgaagtcagttccaccaaatggttccacaatggcagcctttcagaagagacaaattcaagtttgaatattgtgaatgccaaatttgaagacagtggagaatacaaatgtcagcaccaacaagttaatgagagtgaacctgtgtacctggaagtcttcagtgactggctgctccttcaggcctctgctgaggtggtgatggagggccagcccctcttcctcaggtgccatggttggaggaactgggatgtgtacaaggtgatctattataaggatggtgaagctctcaagtactggtatgagaaccacaacatctccattacaaatgccacagttgaagacagtggaacctactactgtacgggcaaagtgtggcagctggactatgagtctgagcccctcaacattactgtaataaaagctccgcgtgagaagtactggctacaattttttatcccattgttggtggtgattctgtttgctgtggacacaggattatttatctcaactcagcagcaggtcacatttctcttgaagattaagagaaccaggaaaggcttcagacttctgaacccacatcctaagccaaaccccaaaaacaactgatataattactcaagaaatatttgcaacattagtttttttccagcatcagcaattgctactcaattgtcaaacacagcttgcaatatacatagaaacgtctgtgctcaaggatttatagaaatgcttcattaaactgagtgaaactggttaagtggcatgtaatagtaagtgctcaattaacattggttgaataaatgagagaatgaatagattcatttattagcatttgtaaaagagatgttcaatttcaataaaataaatataaaaccatgtaacagaatgcttctgagtaaaaaaaaaaaaaaaaaaaaaaaaaaatctcaatataataatattctttattcctggacagctcggttaatgaaaaaatggacacagaaagtaataggagagcaaatcttgctctcccacaggagccttccagtgtgcctgcatttgaagtcttggaaatatctccccaggaagtatcttcaggcagactattgaagtcggcctcatccccaccactgcatacatggctgacagttttgaaaaaagagcaggagttcctgggggtaacacaaattctgactgctatgatatgcctttgttttggaacagttgtctgctctgtacttgatatttcacacattgagggagacattttttcatcatttaaagcaggttatccattctggggagccatatttttttctatttctggaatgttgtcaattatatctgaaaggagaaatgcaacatatctggtgagaggaagcctgggagcaaacactgccagcagcatagctgggggaacgggaattaccatcctgatcatcaacctgaagaagagcttggcctatatccacatccacagttgccagaaattttttgagaccaagtgctttatggcttccttttccactgaaattgtagtgatgatgctgtttctcaccattctgggacttggtagtgctgtgtcactcacaatctgtggagctggggaagaactcaaaggaaacaaggttccagaggatcgtgtttatgaagaattaaacatatattcagctacttacagtgagttggaagacccaggggaaatgtctcctcccattgatttataagaatcacgtgtccagaacactctgattcacagccaaggatccagaaggccaaggtcttgttaaggggctactggaaaaatttctattctctccacagcctgctggttttaagcttttcaaaggtgcaattggataacttctgccatgagaaatggctgaattgggacacaagtggggacaattccagaagaagggcacatctctttcttttctgcagttctttctcaccttctcaactcctactaaaatgtctcattttcaggttctgtaaatcctgctagtctcaggcaaaattatgctccaggagtctcaaattttcttatttcatattagtctttatttagtagacttctcaatttttctattcatcacaagtaaaagcctgttgatcttaatcagccaagaaacttatctgtctggcaaatgacttatgtataaagagaatcatcaatgtcatgaggtaacccatttcaactgcctattcagagcatgcagtaagaggaaatccaccaagtctcaatataataatattctttattcctggacagctcggttaatgaaaaaatggacacagaaagtaataggagagcaaatcttgctctcccacaggagccttccaggtaggtacaaggtattatttttttctaccctcagtcacttgtggcaggggaagtcatagtcacggtgcttaggagatgaaactttattgatttaggcatggatccatctagtttaattaatatattgggtatgaggaagctacttgctgtactttccatgtggttctctctccctggagaggaacatttttactcagcttgcaaactggaaatagattttctcacattagaagctcattttctgggtatgagacaggagagttcatactgtgtatgtagatctctggcttctgggtctgacatgtgctgagggacacatatccttcacacatgcttttataaatacttgataaagtaacctgcttcttgattggtctttataatccataagctgtgggatgcttctctgaagatgaaaatagtaatagagtcccatctagctattcaaagccattccttcattgtattctgtgcacatgaagttggggtttgttactgacaaaatatattcagatacatttctatgttaaaaggattgtgagatgcataggtaaatgtgtttattttcagttttacttgtcaacatagatgaatgagaaagaacttgaaagtaacactggattaagaataggaaaatttggcatggattttgctccattttgtcccatctaatcacttggatagtgttcaggtgttcttggtcagttacttggatgctctgagctttagtttcttggtgattacaatgaagatttgaattacaggatggctttgaaaaaataaacaaaactcccctttctgtctgtcgagaatgttgcacagggagttacagaatgttctcatgactgaattgcttttaaatttcacagtgtgcctgcatttgaagtcttggaaatatctccccaggaagtatcttcaggcagactattgaagtcggcctcatccccaccactgcatacatggctgacagttttgaaaaaagagcaggagttcctgggggtgagtgagcctcctccaactttgactagagtaagggttgggtctagaaaagaatattgagttgcatcaactgttttcccacttggattcatgagaggtgttaggtcctttaaaaaacatggtagataaagagttgacactaactgggtccttttgggaagagccagaagcatttcctcataaagactttaaattgctaggacgagaatggccaacaggagtgaaggattcataactttatctttacttagatgtaaagaacaattactgatgttcaacatgactacatacataaaggcgcatggagaaaagtattggccttccatgcattaggtagtgcttgtatcaattcttatagtggctagggtatcctggaaaatcttacgtgtggatcatttctcaggacagtctaggacactaacgcagtttctcatgtttggcttctattattaaaaaatgatacaatctcgggaaaatttttttgattttcatgaaattcatgtgtttttctataggtaacacaaattctgactgctatgatatgcctttgttttggaacagttgtctgctctgtacttgatatttcacacattgagggagacattttttcatcatttaaagcaggttatccattctggggagccatatttgtgagtatatatctataattgtttctgaaataacactgaacataggtttttctctttctcagatctaaccagttgtttattcccagtattaagatgatatttataattcttaattataaatatatgtgagcatatataacatagatatgctcattaacaacaacaaaagattctttttacaattaacggtgggttaaacatttagcccacagttttatcccatgagaaacctgaatctaatacaagttaaatgacttgcctaagggccacttgactaatagtaattgaacctaaactttcagaatccaactccaggaacatacttctagcactattcatcaataaagttatatgataaatacatacaactttatctgtcaactaaaaataacaacagaggctgggcatggtggctcacacccgtaatcccagcactttgggaggctgaggcaggtggatcacctgaggtcaggagtttgagaccagcctgaccaacatggtgaaacctcatctctactaaatataaaaaattagctgagtgtgatagtgcatacctgtaatccagctacttaagaggctgaggcaggaggcttgtttgaacctggaaggcagaggttgcagtgagctgagattgtgccattgcactccagcctgggcaataagtgcgaactctgtctcaaaataataataataataatagaaaataaagttgtcttcatgaaaaatgaggaaagagattgctggggtgagaaacattaagatcaatgggcatatggtgaccttctatgccctagaaactcttttanggtattttctcctggtatctcttttacncatcgttctatctggaaaaataggtggatgagtgagataataacggtatatactttttaaaggtctaattgacatatataaattgcaagtatttcagatgtcaatttgctaaccttgacacacatagacacacatgaaaacatcaccacattaatacaatgtatgtatccatcattccaaaagcttccctgtgtatctttgtaactctttcttcctccctccactccttgtcctctcgttcccaagaaaacattgatctgcttcctgtgaatataaattaacttacattttttagagctttatataagtatgttctctttactgtttgtcttccttcgctgcacagttattttgagattcttcaagttttttctttatatcgatacttcattcacaagaatatattttaattctagactatgtcacattgactttgtcgtctgctaaatccttagtgctcagatgacttgttcaggactctccttgaacctgtacctctgttanattgaaacttgtctctactgtctttttatttcaaacacagcttattaggtgtctctcaacccatcaaacncacaatctgagtctttaggagattgctttgaatttgtgctattgacttatatntatatnaaatntgtaaatgtttggtaaaaatatcatcatgtacnttttcataattacgctatntncacatgatatatgtcagactctggaaatatgcatgccacagacacgtgtttcttgcctaaaggggctgatggaagacncacatacnaatagacgattgcagtagaatgagagtggtggtctaancagtacatgtcctgatgttgctcggacagttactacnccaagagtaccccctgcattgtcagggttagcatctcctggaagcctcatgtaaatgaagaatttcatgctccatccaggacctaatgaataagaatctgcattttagcaagaccctcatatgattcatatacactttttttttttttttttagatggagtctcactcttgtcgcccaggctggagtgcaatggcatgatcttggctcactgcaacctctgcctcccgggttcaagtgattctcctgtctcagcctccctagtagctgggactacaggtgcatgccacagtggctggctaatttttgtatttttagtagagacagggtttcaccattttggtcaggctggtcttgaactcatgacctccggtgattcccccgcctcggcttcccaaagtgctgggattacagacatgagccaccacacccgccttattcgtatacncatttaattctgagaagcactctatagaaaataagaataagaaaatattgggctcacaggtgacattaataagtaactttatcgagtaccccaaattttacctatgtttggaagatggggttaaaaggacacattgaaaacaagaactcattgtggcttttttttcctcctttttgaacagttttctatttctggaatgttgtcaattatatctgaaaggagaaatgcaacatatctggtgagttgcccgtttctgtctttgtccatccttgaaaagataagaagaacagagttttaagagtcttaagggaaacacatctttgtctcctatattacttgtgaatgtggatatatgattttgtttcaatctattttgtgtcctaaggctttttgcaacagaagttggatatatcattagaaacataaattgtaccatttaacatacatgaagtttatgtttaccttgacgttcttctaaaaagtgtcctacaccggcattgtccttgtaggcatattcacatgatcaaataaaataattagttttcaattaaggagaatatttgaggaaagaccgtacgtgttcatgtggttcctgaaggcagtccagtgagaaagtaatatatgcttcattaaacaatgcggacattttcagggtttccctttttaaccaaaatttggaagcaatgtggaatttactggatgcatccagccctgaaatgaagataggtttattgaatgtgccagcaagtgcaggcccaggtctgagtgttcttcattattatcaggtgagaggaagcctgggagcaaacactgccagcagcatagctgggggaacgggaattaccatcctgatcatcaacctgaagaagagcttggcctatatccacatccacagttgccagaaattttttgagaccaagtgctttatggcttccttttccactgtatgtatttttttttgtgtgggaagactaagattctgggtcctaatgtaagtaagaagccctcttctcctgttccatgaacaccatccttttctgtaacttctattacacagtatagtggttctgtaagttcacacagcccagggagatgctggctgcccactcccctcaacccaggcaaattcctcggggttaaagttatctactgcaagtgacgatctctgggtttttctgtgcctgtgtttgtgtgtgtgtgtgtgtgtgtgtgtgtgtgtatgtgtcactttaaaaggactggtcagatggtagggagatgaaaacaggagatgctataagaaaataaacttttggggcgaataccaatgtgactctttttgtttgtcatttgttgctgttcaataggaaattgtagtgatgatgctgtttctcaccattctgggacttggtagtgctgtgtcactcacaatctgtggagctggggaagaactcaaaggaaacaaggtagatagaagcccgatataaaatcttgaatgacaggttaacgaattggagctttattccttaaaatatggcctgggttttctgaaacatttcttccagaaaatagtttctccaagttttattactttggtttacaaatctcacatttaaatcacattttataccataagtagcacacatttcataatattcctctgaatgagggttgggataataggactgatatgttagaaatgccttaaagtgtgtggagcatgagagatggatgtacagaaggcttgtgaggaaaccacccaggtatctggccttgttttctgccccagaactagccgcctattcctgtttctgttttattcctttgtttcttgacttttcctttccaacttgctctaaaacctcagttttctttcctttctgattcatgactaccaaatgttttcacttgcctcacccgtccattacacctttgataagaaccaccagaccttgtgctcatgtacttgcccatgtctgatggaagaaacatactctctccatctgtccactttcctgaggcattcaagtctagccaccttttaaaatcactctcctccaggctgggcacggtgtcacgcctgtaatctcagcactttgtgaggctgaggagggcggatcacttgaagtcaggagttcaaaaccagcctggccaaatggcaaaaccaaatcttcttcaattataaccaaatcttaaaccaaatctctactaaaaaatacaacaaaacaaaacaacaacaacaaaaacagaaaaggaaacattagcccagcgtggtggcaggtacctgaggttccagatacttgggaggctgaagcaggagaatcgcttgagcccaagagatggaggttgcagtgagccgagatcatgccactgcaccacagccagggtgacagagccatacttcccagcacattgggaggccaaagctgaagaataatttgaggtgaggatttggagaccagcctggccaacatggtgaaactccgtctgtactaaaaatataaaacttagtggggcatgggggcacacacctgtaatttcagctacttaggaggctgaggcaggagaattgcttgaacccgggaggcggaagttgcagtgagccaagatcgtggccactgcactccagcctgggtgacatagtgagattctgtctcaaaaaaaataaaagaaatttaaaaaatcactctcttccaaagatagataaataagacagcagatatactaaggaataacctcaccaacttgtcattgactgacatgatttcttttggcccacttggccagctagtctggtttggttttctggaaatgaaagaaataatcagagtttaatgacagagagcgtgagacccagaaagacaaaagtagatgaggtaagtctcttgagcgagacttctagggatgggaaatttgtggtgattgatatgaaatgatttttcccttatcaggttccagaggatcgtgtttatgaagaattaaacatatattcagctacttacagtgagttggaagacccaggggaaatgtctcctcccattgatttataagaatcacgtgtccagaacactctgattcacagccaaggatccagaaggccaaggttttgttaaggggctactggaaaaatttctattctctccacagcctgctggttttacattagatttattcgcctgataagaatattttgtttctgctgcttctgtccaccttaatatgctccttctatttgtagatatgatagactcctatttttcttgttttatattatgaccacacacatctctgctggaaagtcaacatgtagtaagcaagatttaactgtttgattataactgtgcaaatacagaaaaaaagaaggctggctgaaagttgagttaaactttgacagtttgataatatttggttcttagggttttttttttttttagcattcttaatagttacagttgggcatgatttgtaccatccacccatacccacacagtcacagtcacacacacatatgtattacttacactatatataacttcctatgcaaatattttaccaccagtcaataatacatttttgccaagacatgaagttttataaagatctgtataattgcctgaatcaccagcacattcactgacatgatattatttgcagattgacaagtaggaagtggggaacttttattaagttactcgttgtctggggaggtaaataggttaaaaacagggaaattataagtgcagagattaacatttcacaaatgtttagtgaaacatttgtgaaaaaagaagactaaattaagacctgagctgaaataaagtgacgtggaaatggaaataatggttatatctaaaacatgtagaaaaagagtaactggtagattttgttaacaaattaaagaataaagttagacaagcaactggttgactaatacattaagcgtttgagtctaagatgaaaggagaacactggttatgttgatagaatgataaaaagggtcgggcgcggaggctcacgcctgtaatcccagccctttgggaggccgaggtgggcagatcacgaagtcagtagtttgagaccagcctggccaacatagtgaaaccccgtctctactaaaaatacaaaaaaaaaattagctgggtgtggtggcagtcacctgtagtcccagctacttgggaggatgaggcaggagaatcgcttgaacctgggaggcggaggttgcagtgagccgagatcgcaccagtgcactccagccttggtgacaatgggagactccatctcaaaaaaaaaaaaaaaaaaaaaaagataaaaagtcagaaatctgaaaagtggaggaagagtacaaatagacctaaattaagtctcattttttggctttgattttggggagacaaagggaaatgcagccatagagggcctgatgacatccaatacatgagttctggtaaagataaaatttgatacacggtttggtgtcattataagagaaatcattattaaatgaagcaagttaacactctaagagaattattttgagatagaagtgaagctaagctaaacttcacatgcctataattggagggaaaaactaaggataaaatctagcctagaagatacaataattagtcataaacatgcattgtgaaactgtagagagcaggtagcccaaaatagagaaagattagataaagagaaaataagtatccatcagagacagtatctctaggcttgggcaagagaaaagtccacagtgataagcaactccacctaaggcatgaatatgcggcagagaaaacagcaatagtgaatgaatgcaaaaggtgctgagcaaattccacacatgagtattgtgcatgagtaaatgaataaaacatttgcaaagacctttagagaaagagaatgggagcatatgtgcgaaataagatagttgattatgaatagaaggtagtgaagaaaagcaagctaagaaaaaattctgtttataaaagaaggaaaagatagtttatgtttttagcctaagtataagagtcctacagatggactgaaaaaaatcagtctgagagtattagtcacaattaatgaaataattacattttatgtattgaggatgccaagattaaaaggtgacaggtagatgttaatttccctagattgtgaaagtgatcacgacaatcacacaacaaataattaagtgacttggtatgctttatttaattgtagggcctgaggttttccattctcatttttctaaaatacaattttgtttctccaaatttgacagcagaataaaaaccctaccctttcactgtgtatcatgctaagctgcatctctactcttgatcatctgtaggtattaatcacatcacttccatggcatggatgttcacatacagactcttaaccctggtttaccaggacctctaggagtggatccaatctatatctttacagttgtatagtatatgatatctcttttatttcactcaatttatattttcatcattgactacatatttcttatacacaacacacaatttatgaattttttctcaagatcattctgagagttgccccaccctacctgccttttatagtacgcccacctcaggcagacacagagcacaatgctggggttctcttcacactatcactgccccaaattgtctttctaaatttcaacttcaatgtcatcttctccatgaagaccactgaatgaacaccttttcatccagccttaatttcttgctccataactactctatcccacgatgcagtattgtatcattaattattagtgtgcttgtgacctccttatgtattctcaattacctgtatttgtgcaataaattggaataatgtaacttgatttcttatctgtgtttgtgttggcatgcaagatttaggtacttatcaagataatggggaattaaggcatcaataaaatgatgccaaagaccaagagcagtttctgaagtcctccttttcatcagctctttatcaaacagaacactctataaacaacccatagccagaaaacaggatgtaggaacaatcaccagcacactctataaacaacccatagccagaaaacagaatgtaaggacaatcaccagccatcttttgtcaataattgatggaatagagttgaaaggaactggagcatgagtcatatttgaccagtcagtcctcactcttatttacttgctatgtaaacttgagaaagcttttttctctttgtgaacctcaggttttacatctgaaaatgagaaatttggaacaaaagattcctaactggtctttctgttcccatattctgtgatttttcaatatttaggatttttggtaatcacaattacttagtttgtggttgagatagcaacacgaatcagaactatttggtggacatattttcaaaggagtagctctccactttgggtaaagaagtgatgcnggtcgtggtggctcacgcctgtaatcccagcactttagggaggccaaggcgggtggatcacgaggtcaggagatcgagaccatcctggctaacacggtgaaaccccgtctctactaaaaaatacaaaaaattagccaggcgtggtggcgggcgcctgtagtcccacgtactcgggaggctgaggcaggagaatggcatgaaccagggaggcggagcttgccgtgagccgagatagcgccactgcagtccctcctgggcaaaagagcaagactgcgtctcaaaaaaaaaaaaaaaaaaaaaaaaagaagtgtgtggagtagcaggacacctgcaacaataatatttttctaaatccctctgaaaaatgctaatcaaagggtttttttcctaaaaattgtcttagaaataaaatttcccctttgggagaccgaggctggcagatcacgaggtcaggagatagagaccacggtgaaaccccgtctctactaaaaatactaaaaattagccggggngtggtggtgggtacacctgtagtcccagctacttggaggctgaggctggagaatcacgtgaacgccacgtgctgctgggtctcagtcctccacttcccgtgtcctctggaagttgtcaggagcaatgttgcgcttgtacgtgttggtaatgggagtttctgccttcacccttcagcctgcggcacacacaggggctgccagaagctgccggtttcgtgggaggcattacaagcgggagttcaggctggaaggggagcctgtagccctgaggtgcccccaggtgccctactggttgtgggcctctgtcagcccccgcatcaacctgacatggcataaaaatgactctgctaggacggtcccaggagaagaagagacacggatgtgggcccaggacggtgctctgtggcttctgccagccttgcaggaggactctggcacctacgtctgcactactagaaatgcttcttactgtgacaaaatgtccattgagctcagagtttttgagaatacagatgctttcctgccgttcatctcatacccgcaaattttaaccttgtcaacctctggggtattagtatgccctgacctgagtgaattcacccgtgacaaaactgacgtgaagattcaatggtacaaggattctcttcttttggataaagacaatgagaaatttctaagtgtgagggggaccactcacttactcgtacacgatgtggccctggaagatgctggctattaccgctgtgtcctgacatttgcccatgaaggccagcaatacaacatcactaggagtattgagctacgcatcaagaaaaaaaaagaagagaccattcctgtgatcatttcccccctcaagaccatatcagcttctctggggtcaagactgacaatcccgtgtaaggtgtttctgggaaccggcacacccttaaccaccatgctgtggtggacggccaatgacacccacatagagagcgcctacccgggaggccgcgtgaccgaggggccacgccaggaatattcagaaaataatgagaactacattgaagtgccattgatttttgatcctgtcacaagagaggatttgcacatggattttaaatgtgttgtccataataccctgagttttcagacactacgcaccacagtcaaggaagcctcctccacgttctcctggggcattgtgctggccccactttcactggccttcttggttttggggggaatatggatgcacagacggtgcaaacacagaactggaaaagcagatggtctgactgtgctatggcctcatcatcaagactttcaatcctatcccaagtgaaataaatggaatgaaataattcaaacacaaaaaaaaaaaaaaaaaaaaaagccggagccgactcggagcgcgcggcgcggccgggaggagccgagcgcgccgggcgcggcgtgggggcgccggctgccccgcgcgcccagggagcggcaggaatgtgacaatcgcgcgcccgcaccgtagcactcctcgctcggctcctagggctctcgccctctgagctgagccgggttccgcccgggctgggatcccatcaccctccacggccgtccgtccaggtagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggtataaagatgacagcaagacacctgtatctacagaacaagcctccaggattcatcaacacaaagagaaactttggtttgttcctgctaaggtggaggattcaggacattactattgcgtggtaagaaattcatcttactgcctcagaattaaaataagtgcaaaatttgtggagaatgagcctaacttatgttataatgcacaagccatatttaagcagaaactacccgttgcaggagacggaggacttgtgtgcccttatatggagttttttaaaaatgaaaataatgagttacctaaattacagtggtataaggattgcaaacctctacttcttgacaatatacactttagtggagtcaaagataggctcatcgtgatgaatgtggctgaaaagcatagagggaactatacttgtcatgcatcctacacatacttgggcaagcaatatcctattacccgggtaatagaatttattactctagaggaaaacaaacccacaaggcctgtgattgtgagcccagctaatgagacaatggaagtagacttgggatcccagatacaattgatctgtaatgtcaccggccagttgagtgacattgcttactggaagtggaatgggtcagtaattgatgaagatgacccagtgctaggggaagactattacagtgtggaaaatcctgcaaacaaaagaaggagtaccctcatcacagtgcttaatatatcggaaattgaaagtagattttataaacatccatttacctgttttgccaagaatacacatggtatagatgcagcatatatccagttaatatatccagtcactaatttccagaagcacatgattggtatatgtgtcacgttgacagtcataattgtgtgttctgttttcatctataaaatcttcaagattgacattgtgctttggtacagggattcctgctatgattttctcccaataaaagcttcagatggaaagacctatgacgcatatatactgtatccaaagactgttggggaagggtctacctctgactgtgatatttttgtgtttaaagtcttgcctgaggtcttggaaaaacagtgtggatataagctgttcatttatggaagggatgactacgttggggaagacattgttgaggtcattaatgaaaacgtaaagaaaagcagaagactgattatcattttagtcagagaaacatcaggcttcagctggctgggtggttcatctgaagagcaaatagccatgtataatgctcttgttcaggatggaattaaagttgtcctgcttgagctggagaaaatccaagactatgagaaaatgccagaatcgattaaattcattaagcagaaacatggggctatccgctggtcaggggactttacacagggaccacagtctgcaaagacaaggttctggaagaatgtcaggtaccacatgccagtccagcgacggtcaccttcatctaaacaccagttactgtcaccagccactaaggagaaactgcaaagagaggctcacgtgcctctcgggtagcatggagaagttgccaagagttctttaggtgcctcctgtcttatggcgttgcaggccaggttatgcctcatgctgacttgcagagttcatggaatgtaactatatcatcctttatccctgaggtcaccaggaatcagg

SEQ ID NO: 3003 - DNA, 35459 bp; single-stranded, linear
cttgctcctgggggcctcctggtccctctggctgttcccggccctggbctggggcbggggccgcgtbggcgcggctcgccbggbcgggcbgcgccbgcbgcbgcbggctcbgcbtcctggccbcggbbttccggtgtgcggggcctggtgcccctgggcctcgggtgctgcctgtgcgctgccttcttctcctgggtcctcgccggggcccttgctgccctggctgtgccctgggggtctgggttcggctgtccccbgcbggbccbgtcccbtccbcbgcgtgtgbtgbgtbgccbttctcctgcbgccgbggggcgcgggcgbgcbtcgctttgggcttttctcctttggtttgbgcgccbggbccgcgcbcbgcbgcbgggcgcgggcgbgcbtcgcbgcggcgggcbggggggctcccgccgcgbgbggttbtgggctcccbggbccbcccgcbccgcgcggbcgtttbcbttcgccbcgcbgtgcgcggccgbcbtgbcgbbgttgggcgcbbtcbgggtggcgccgcbgbbgtggcctccgcgcbgctgcbgggbcbccbtgbbgggccbcgcgtggggccgcgctcgccggccccccbcbbtctccgbggccbgcgcggtgccccccbgcbgcbbggccggcbggbcbcbggcgbggbgbcbcgcgbgtcggcggccgbgggtcbtggtggggctggggctccggggtctctgcccctccgtgctggtggggctggggctccggggtctctgcccctccgtgccgcgtggggccgcgctcgccggcccccccctgccgggtgggctcccgccgcgcgccggcctgccggcccctcgtgggtcctgctggccgggtccgggtcccgggggtggggcgcgbgtcggcggccgbgggtcccctccbcbtctgctctgbcctgctggbctctggbtctgbbgbtbcgccbtgtbggggcgggbgtggggcctgctctcccggcctccgbtgbtctcccctgcctcbgccccbgtgggtbggbgbbbggccbgcbgbbgcbggbgtggctgcbtctttcctggtggggcctgctctcccggcctccgtgtgttgctgggtgttttcccgtctctggtctgccttcgggggtcgtccggggctgcbgcbbcctcbtcbgctcttgcctggbgtggctcbgcctgggcctgcbgggccbccbggbgbbtggcbgcbbggbtggcgbgggtcctcbtggctggggtcbcbgbtcctctbgctbggcbgggtgbccbgbgbgggcgggtcctcbtggctgggggcctgggcctgcbgggccgctcttgcctggbgtggctcgcccbgbgtcttccctggtcgctgcbbtctgctccggggctgcbgcbbcctcbtcbgctcttgcctggbgtggctcbgcctgggcctgcbgggccbccbggbgbbtggcbgcbbggbtggcgbgggtcctcbtggctggggtcbcctggbggbgggbgbgcbgggggtcctcbtggctggggtccctctctcccgtcctcggtttcctttgcggtcttggcccgggctccgggtgcccgcccgcccgccggccgccgccccgccgggctgtccccgccccgccccggcccggggcgcgggggcggccctcccgcccctctgggccggcgcgggcgtcggccgctcgcgcctggggttccctctcctccccctgtgcgcctgcctcttgctcttctgcgtccgctgccttctcccctctcctcggccgttgcctgtgctgtccgtcctgtcgcccttccgtggtgctgttgtctcttctgccctcggtgtgctggtgctggtggtggtgcctctgcccgtgctcgccctgcctgggctggcctcttcgggtgtggctttggggctctcttggttgccctttcttctcgtggtgcctctcctccctggcttggtcgttgtctggggtggtgctcctctccctttccctgctggccgtttgtcctgttttctgtcttcctctttcctcctgtttctccgtttggcttgctgcttgcggggctgtctcccttgcccctgtgggctttccctggtccggtcttctccttgggggtcgcccttcttggtgggctggctcgtctgtctttttccttcctgggggtggccgttgtgggcggtgtggtccgccttgcctctgctggtctttcctcggtbgbcgcgctcgbbctcgggtgggccggtggtgbgcggcggcgbcbcgcggbbggccctgcgcgccgbgbtcbcctgcbgggbgbbgtbggcttgcbgcbggbctcccbggbgggtgbcbgcbgccbgtbgbgctbcctcgtccttcbtggtbccgtcggtgtggtggcbcgggctgtgtgtgbbggcgbgctgggccccgtctgctgctcctcgtgccgcctcgtccttcatggtaccgtcggtgtggtggcctcgggtgggccggtggtggggcgcgcgcgctcgcgtggctccggctcttctttcccggctccgtcggcccgggggccttggtctccctcgtccttcbtggtbccgbccggcggbgccgccbgggtggbctgggbgtgggtttctccccgccgttctcbcccbccgcgctgbgctcbgcgcctbbgbctgctgtttctggbgctccttggcbbgccbcbbbcbgcbgbgbgbbbbtcbtgbgcbbbtbbtccbttctgbbbbbbbgggbtcbbbbbcctcccgttccccgttcgcctggcgcgcgctgcgggttcctcgtgggtttctccccgccgttctccggtctgttgcctttgtgggcttcttgtctttttggctgttcttttcctgcttggcgtcttttcctttctttgtgctcggttgtgggtccgctggtcctttgccctgtgtgtttctgctgcccgttcgcctggcgcgcgctgcgggttcctcgtgggtttctccccgccgttctccggtctgttgcctttgtgggcttcttgtctttttggctgttcttttcctgcttggcgtcttttcctttctttgtgctcggttgtgggtccgctggtcctttgccctgtgtgtttctgctgggbgctgbtbctgcbgatttcbgbgggbbgbbccctgbtbctcbccbgcttcbgctctggbgcbcbbgbgbbbgbgcbgcbgggggbgbggbbgbbgcbgcbtcttcccbgbgbggctgcctgbgcbbbtgctggttttcctttccbgtcttgggttttbtbbctcccbgbbggcbbgbgbggggcbbggcgttttcttctctcgctggttttcctttcctggcagtgggtgggggtgggggtggggtggcttccttgttcctgggggtgtcctcttgctctgggcttttctccccttttccttcctgtctgttttcctggggctctcctctgtctctgtgtccttgccctggccctcttccctctcctgtctcctgtccctgtgttccgcccgtcttccctctcctgacctccttttcctccgctgggtggggccctgcctgttctctgctccctggcttggggtttcttctgtgtgtcttcttcctctgttggctggctttctccttcttttgtcttcctgggtgccccttcttcctttcttgggtccttggtgcttgggctggggcgtcttggggtgcbgggcccbtcctgctgcgcctgggcgctgctgtgcgtccgtctgctggggggccggggtggctgggccctgcttgccgcacgaccccgggccgacccgaggctcggggggctgtgttctggcgctggtgggcttgggcccctctgggggctgggtttcctgctgcgcctgggcgctggcgtcttggggtgcggggccggggggccggggggccgctgttcgtgggcctgggggtgcctgtggctgccggttgccccggttggtggcgccgtcctgctgccggtcgttggctgggtccccccgcccgtttcctggggtccgcgtggggtgctccggttcctcgtgccgctgctgccttgtctttccggccgtggcggcgtggtggtccgccccccctggccttctgctcggggtctggctggttgccggtgcccttggcggcggtcttcttcctggtggctctgggcccggccggtctcgggcgtctcgtgttcgctcttgtgctgttccggccgctccttcctcttccgccgccgccgctccccgcccgctcgtcgccctggcccggcctcctcctggccgctgtctcgggcggcggccttggcgctccgtttggggctgcctctggcgcttccggccctcggcctgggcgctctcttccgcctgtgctggtggccctcgtgggcccctcctggcctccggtgtcctgtggtcccccggctggtggccgggccggttgggcgggcgtgggcgccggcgggtcctccgggctgcccttctccgccgggggtcccgcgctcctgctgttccctgggctcttctgcctctctcctgggtgggtgctgggtgccggggtctccgggcttgccccgcgctgctgggcgttctgcggtcttggggttgtctgtggccccgctcgtgtcgccctccgtcgcccgtcgccggcctcgtcccctcctgggtgcgcggcgggctggtcctggcgttttgctccttcctgggcgtcttggggtgcbgggcccbtcctgctgcgcctgggcgctgctgtgcgtccgtctgctggggggccggggtggctgggccctgcttgccgcacgaccccgggccgacccgaggctcggggggctgtgttctggcgctggtgggcttgggcccctctgggggctgggtttcctgctgcgcctgggcgctggcgtcttggggtgcggggccggggggccggggggccgctgttcgtgggcctgggggtgcctgtggctgccggttgccccggttggtggcgccgtcctgctgccggtcgttggctgggtccccccgcccgtttcctggggtccgcgtggggtgctccggttcctcgtgccgctgctgccttgtctttccggccgtggcggcgtggtggtccgccccccctggccttctgctcggggtctggctggttgccggtgcccttggcggcggtcttcttcctggtggctctgggcccggccggtctcgggcgtctcgtgttcgctcttgtgctgttccggccgctccttcctcttccgccgccgccgctccccgcccgctcgtcgccctggcccggcctcctcctggccgctgtctcgggcggcggccttggcgctccgtttggggctgcctctggcgcttccggccctcggcctgggcgctctcttccgcctgtgctggtggccctcgtgggcccctcctggcctccggtgtcctgtggtcccccggctggtggccgggccggttgggcgggcgtgggcgccggcgggtcctccgggctgcccttctccgccgggggtcccgcgctcctgctgttccctgggctcttctgcctctctcctgggtgggtgctgggtgccggggtctccgggcttgccccgcgctgctgggcgttctgcggtcttggggttgtctgtggccccgctcgtgtcgccctccgtcgcccgtcgccggcctcgtcccctcctgggtgcgcggcgggctggtcctggcgttttgctccttcctggctgccccbgtttttgbtcctcbcbtgccgtggggbggbcbbtggctgcctccccggggtttctgctgcttgctgcttctttcccgtctcccttctttcccgtctcctttttgcctctttgggttcctgttgtttctggcctgcttggtggcggcttgtgcgtttcctctctcttctcttgggtctccgcttctcgtcctgccttttcctgtctctgtcgcgccgttcctcctccggcgtcctcctgccctgtgctgtttgcctcgggtggtgcgggtcccggtgctcccccggcgggccggctggttgcctgggcctgtctggtggggtgtggggccgctgggttgggggtgtggtgggctcttctgtggcctgtggggctgttggtgtctctgtgggcgtgtgctgggtcttggggcttcctcccttgtgctgggtgcggcctccccgccccccttctgggccggtggcctggctccttgtgggcgcttctggctcttgccctgtccttcttcgcctcgtggctgctgggctgcgccgccgccgccaagatggcggacctggaggcggtgctggccgacgtgagctacctgatggccatggagaagagcaaggccacgccggccgcgcgcgccagcaagaagatactgctgcccgagcccagcatccgcagtgtcatgcagaagtacctggaggaccggggcgaggtgacctttgagaagatcttttcccagaagctggggtacctgctcttccgagacttctgcctgaaccacctggaggaggccaggcccttggtggaattctatgaggagatcaagaagtacgagaagctggagacggaggaggagcgtgtggcccgcagccgggagatcttcgactcatacatcatgaaggagctgctggcctgctcgcatcccttctcgaagagtgccactgagcatgtccaaggccacctggggaagaagcaggtgcctccggatctcttccagccatacatcgaagagatttgtcaaaacctccgaggggacgtgttccagaaattcattgagagcgataagttcacacggttttgccagtggaagaatgtggagctcaacatccacctgaccatgaatgacttcagcgtgcatcgcatcattgggcgcgggggctttggcgaggtctatgggtgccggaaggctgacacaggcaagatgtacgccatgaagtgcctggacaaaaagcgcatcaagatgaagcagggggagaccctggccctgaacgagcgcatcatgctctcgctcgtcagcactggggactgcccattcattgtctgcatgtcatacgcgttccacacgccagacaagctcagcttcatcctggacctcatgaacggtggggacctgcactaccacctctcccagcacggggtcttctcagaggctgacatgcgcttctatgcggccgagatcatcctgggcctggagcacatgcacaaccgcttcgtggtctaccgggacctgaagccagccaacatccttctggacgagcatggccacgtgcggatctcggacctgggcctggcctgtgacttctccaagaagaagccccatgccagcgtgggcacccacgggtacatggctccggaggtcctgcagaagggcgtggcctacgacagcagtgccgactggttctctctggggtgcatgctcttcaagttgctgcgggggcacagccccttccggcagcacaagaccaaagacaagcatgagatcgaccgcatgacgctgacgatggccgtggagctgcccgactccttctcccctgaactacgctccctgctggaggggttgctgcagagggatgtcaaccggagattgggctgcctgggccgaggggctcaggaggtgaaagagagcccctttttccgctccctggactggcagatggtcttcttgcagaagtaccctcccccgctgatccccccacgaggggaggtgaacgcggccgacgccttcgacattggctccttcgatgaggaggacacaaaaggaatcaagttactggacagtgatcaggagctctaccgcaacttccccctcaccatctcggagcggtggcagcaggaggtggcagagactgtcttcgacaccatcaacgctgagacagaccggctggaggctcgcaagaaagccaagaacaagcagctgggccatgaggaagactacgccctgggcaaggactgcatcatgcatggctacatgtccaagatgggcaaccccttcctgacccagtggcagcggcggtacttctacctgttccccaaccgcctcgagtggcggggcgagggcgaggccccgcagagcctgctgaccatggaggagatccagtcggtggaggagacgcagatcaaggagcgcaagtgcctgctcctcaagatccgcggtgggaaacagttcattttgcagtgcgatagcgaccctgagctggtgcagtggaagaaggagctgcgcgacgcctaccgcgaggcccagcagctggtgcagcgggtgcccaagatgaagaacaagccgcgctcgcccgtggtggagctgagcaaggtgccgctggtccagcgcggcagtgccaacggcctctgacccgcccacccgcctccaggaagctacctggaggaggtgagtcttagcggatgagtaggagttgtccacggaggaaggtacacagaagggcttccaggcccaggaaacagcagaggcacagaagtgagaatgggtgggtgagttggtggggaaactccaggtgcagaggatggtagcgaaacaaactggagcattaaggtccaagtcctccaagatcttgacttgcagattaaggagtttgttcacctaatctgctttgggcagagtgtggtgagtcctagagacccctctaggtctctcctctcagtagccccagaaggcctggagagctgcttctgggtgccaagcaggcagtgactccatcagatctagatttgggaaaagcatccctggtcagggcctgcatcagggcagtggctggccatgaggaccctgagaagtagacagattcacggagattctcaggaggccagacaggagactatggtgacaaattagattagagaaggggagagaatgaaggagcagttggggtaaaagaaaactgaggctgacatgggtatatgggtggcgagtgactcaccacccactgagaggagaacctcacaagctctgacatgctctggttccaggttctgttggggctgatccaagatggtagcctagaggtgcacagagatgggggccttgctttgcaaaaggatgctggctgctggcccacagcatggtaatgagatttgagctttatgtgcccagggctgggaggagggtcctgtcactttgaaagcaaagagaggctctagagaggggcatgttgagataggaatgctgccttgagacacctggctttccccactctgggtggctctcagcagggtgggtttcccctgccaggcagcactgaacctctgtgcgcttccggctgggagagtttttaccgtaactacatgtggaaccatcctgaaggaacatctggatgggatggggtacagggaagggagctgccaagagtgctggccagggacctgggtctatgagctggttggggggtggggttgggtgcagggtacttgatcctgagtgggccttctgcggccaggattggttctagagtaggaggggtgggatcggggatgggggaagcctgtaactgcgctgcagttgtcaggtcccaggttctgggtgacctactaaggattctgggtccagtgtgggtcccaggttagacgtcctagtcctgagtccgtgtccacagttctgggtgttgagtctaggacagtgatctggagttgacagtccaatctaggtctgagtcctgaccccaagtctagagttcagggtcatggtagtagcctagggtcagaatcaaggttggggtcagtaaccaggatgggatcgaggtcatggtccaaaatctggatctggggacctgttgggggtctgaggtgagtgtcgcagtctgggtatggcgttggagacccagggctgtgatctgaggtcatggttagagtctcaggtggtgggccaaggtttgagtctggggtcctgtttggagtctggtgtcaggtcgtggactgcgtccaaggtcagggagtccggggttatagccagggtctgagatgaaagtcccagatggtgttcagaggtctgaatctgtgtcttggtgagcgtccaggttccctgtgatcacgtttggtgtcagggctgcggcccgactggggagcctgggatccagagatgtgacccgaggttgtggtcagagaatgggtctcgggtcgtcttcgtgccgggtccctgtcgtgttccaggcccgggtctccgtccagcatcgagggccgaggtcacggccagggtctgagcccgcggtcgcaggtctggttcggggtcagattccgcgcggcctccagggggcgccgtcgccgcccggctcggcccctcgcgggctcgctggcgttgtgcgcggcaggcggggccggaggcggcggcggctccgggggcgcgggccgggcggcggcggcggcggcgccccgactgcagtcccggcgggagcggagcgcgaagcgcggggccgggcccggagccggcgccatggggcggcgccgcctgtgagcggcggcgagcggagccgcgggcgccgagcagggccaggcgggagcgtcggcgcccgaggccgagcgagccgcggccgggccgggccgagcgccgagcgagcaggagcggcggcggcggcggcggcggcgggaggaggcagcgccgccgccaagatggcggacctggaggcggtgctggccgacgtgagctacctgatggccatggagaagagcaaggccacgccggccgcgcgcgccagcaagaagatactgctgcccgagcccaggtgaggagaagcttcccagttaatacataatcaatatgcaatttattaatacatctctccatgtccactccccctgtatcttgccattcttgacctgcatttccatcctccttaccttccctagaggccaactcattttctttgaaaaacctggcatttcccagaaaaaaaagtgaagggctgggagctgtccgttgtcctgatttgctccctctgcccttgcttccaaatgtggttggaaagaagcactattgaaaaatccctaaacgcacccctgcagggttggctctaccctgtagccatggacacatgctgttgataccacctgcctcatgagtctcacataatttgccctttcacactatctaccccatcagccttaccaaaaccatacctgcatcctgggcagcatctgcccttcaagagactaaggaatctccttgcaaccaagaatgactagaccaatgagacaccctttaaggccccagcacaatatagaaatcccacaatatggtaatcccagtaaggagctatcaagccattgcaggaccatctagaatacaactagagtatagttcctttcaatccaggaactatactctaacagcttggctcacaggaaccagaagtgaagatgatgaggatcagggctgagcctgtgagcaccagctccaccactgacaccaaccacagattaaacaagcatcttgtggacccctgggatggaaagaatagttgttgccttatcaacctcccccacagcccacacagaaaagataaaatcatcatggctacagtgttacagaagatgatgacccaaggagtaggcctgcctgagtgaatgctgagagtgataatgggagcagtagcatctcagagactacagcagaaaccatccacataaagagctttgcccaaacttatgataaagggcaccctcagagactctccctactttaatattagcccattgcagaaatggtgagtggaaagagaaatcttaggaagaaccccttaaaaaagcaaaatgctttttaggtttgtgctgaagagcctggaaaagaaataaggacacacacgctgagaaatcttcctcctgccccaacactgggataatctccaaggatctctccatatctcattctcctggatacactgtccactcagaaatattgtgcagagtgcagtaattcaaaagtgagctattgtgttaggagtgaaggcaagagtatcgtaaaataaatcaaatttgaaatgaattctcttaaattgctttatagatgtttaatgtaagccagcagctattaaacgataaaccttaaattcgagaaaaacttggtcattcagaaactatagaaacaggcaggacttattgcgagggcaaacacagagtgagctccagcctgcttcaggaaaatctgccagtgccatgaaggatgtactctgtctgctccactgcactactgctcagtatgagcccatgccatcagctgtccctgacccacaggagttctttagaagagactggtcaacaaaagtttctagggtgttttatacctgccaactcgagggttaaaacaagttgcatagaaatgctcaatcaagaaagacacagtcattactcagagaataataaacagcctggcagcacatgaatgaatagaaaaaagatgttacatgcaaagcatgaaataaccaaattccataacagatgttaatctgtaatgtgtttaggagaatttagaggaagtataagatttattctttcatcaaaaaaattatagccaatgaggatatatctatcaattatccatcaagtggtgatatggcagcacaaggtaaaacacaaaggaataaaaccaacgtttattaagaaccaatcatgtggcatttcacattgagcatcatatttaattctgaaaaaaatccttgtactgtatcattcttcatattttatggatgcagtaactaaggctgagaactttaaaatttttcctaagttcagacacatagctaagtggcagaaccaagattcaaactcaccccatctaactgcagagcaaactgcatgccttaaatgtcaaagtgaatactagcacagttaatacaatgtttggaaactcagagaaggaatgatccctctgcattatagttactaaggaatcattgccattatttaaatgccagtgcttctacatcaggcccaaattttctgtcctactaactgtgaatcaagacttgattcaacctctacttgagtatctgccgcaatgagaaatcacttacctccactaaccacacatttattttataacaacagattgttagtaagtcctttcttatacatactcaacagctgcttcccaagatgctgtaggattatgtctagagtcaaactagccagaagcaatgtccaaaatacaccataacactgtgcagcaaaggtcctactaccacttgtttggcccaaacattctaggcagcactggatatctgaatcatcaattatttccacaaacactgacccctctaccagtcaccctcactagaagaattaattccacatgataatagctccctcatgttactcccttctaagtcaaattgtacacccctttatctgattaacagagtctaagtcacatgacctaaatgcaagagaactgggaatggacgtttgtggattctaccttagtaaggcaaagttatcattgggaattcctctaatacaggaagggtgttccagagacattaaggagccatataaatggaaaatgtccactacaatccatcacttggttgccccacatcaacattcattcttttgccacacttaaagtttccaagaacaaaaattatcccactgaacataatctttactatcttttatataaaggaaaattagacttgactcagcagaactgaaataacccagctctaacagttactgcttttaacttcaagtactgtgtctctaggtgatacctgctccaacaatagtttggtcacattttcaatttgatattctctagtctcccaacttgataactgtaccctaaaccataaagttcactaccaacatgctatatataaaataaccaaagggggaagaagaaagagaaaaaggaaatctcttaaaatacacaggtatacatatgacaaagcaaagaaggaaatgtgagcagatagtgcagtcctcgtttctgaaattggtcccctgactggggctatacctattccatttcctcaccctcagccaggcaggtggagcaaaaacttaagtcttggtggatctgaatcttgatgctgtggagctgtcttactagccccagactacctgcctctcaatttctaattatatcagtgaaagcaaacagctttgatttgtttaagcctctgattttttggtctaactgatgtaagaccacaaggacaagagttctccagctccggattctcttctgttctgttaatggtgaaatgcccgagagaagagttgccaactttggcaaataaaaaatacaggattccagttaaattcaaatttagataaacaacaattttttagtattagtgtgtcccattcaatatttggacatacttaactaaaaaatgatttgttgttcatctgaaatacaaatttaactgggcattctgaatattctctggcaacccccgagagagtgaagaaagtggtacaaggacacttaagaagaccagatttgaaaagacattacggatgtgtttaaatgtcttattctagagagagttagagctgtaggtagaacttgggaaattaagttaaaagcagacacagagacctggccaatatatactaaggagtggatcactctggtcacaagcccaacctgagaccaagggcatagtgagatgatttgggaaaggcacttatacactactcatccccgtctttgaactaaatgccttataaatctccaagagaaatgacagtccaccatgtggactgctttctgtaagtccagggaaaataaaagctatgtgcttgaaacccacttctgatattataaggtgtgtgatctttgtcatgttaatgggtctgagtatcaattctacaattgtaaagtgacagtaatggtgtgtccccaggttgttgtggaaagcttgattcttaatgcaacagtaggaaaccccagcctctctggagcaaacacccttctacatctttacttcccctgcacattggcaggactctattcctctatttctctctagtgctagagcagaaagggaccttgatttgatatcaggaaaatctatttctgaaccataagctatgatagctgatttaaaaaattgactatcatgacatgataatgatcataatggtaatacatattgatagggttgccgtgaaagtaataatatatctaagagttgtgacaatatatgatacgcctagactctcagaaaatgctaattccaatcccaattgctctttgcataaagttctgtcctagggtctgttcttttcccacatctaccctccttggatctctcttctgtctttttcatgtggttcagaggaggagagagatccaggtcaatgtttttcaaattacaaggaattatcatttaaatggggaagaagctcaagttttgacgtgtagtggaattggagtggagtggagtggaatggaaactaacaggaagacactgcacatggttaagataaagattgtttcctgaaacctttaatttgtgcttacatactcacacatacatatgtgcatgcactgggactctgcaatatgcatttctgactatggaacatagccataaaagtctttgcactgaacgttcagtgggcctttcacaagctgccctaattgggaaagaaaaacatggtccctccatttcctgcccccaactccagaaaagtcaccatagttgagggtacatctgagaagccagcacttgggagttcagggctcaagttcctttctagaaaaacactgggtgattctaggggaacttccgatcagaaacagccaattcagagtgagagaagaaaacgtgaccatgcagttcctgtggttaccagccttgcccctctcttgccttctgggagttataaaacccaagactggaaaggaaaaccagcatttgctcaggcagcctctctgggaagatgctgcttcttcctctccccctgctgctctttctcttgtgctccagagctgaagctggtgagtatcagggttcttccctctgaaatctgcagtatcagctcctgaaacaaagatgtttagtctgaaatagctgactcctaaacagggttccaagatctctcttcaagagtcccacagaggaaatttccacttgggatgtgtgccaccccacccccacccccacccactgccattctctacagcctaggacacccccaggaacaaggaatttcacctcaattgtagaaaagcccagagcaagtggaaggaaaaggggtatccccaggaaaacagacatgtcctcttaatcttctgagcatcagggctacccattactttgtgactttctcactctgtgaccatgctcaagagctatggagaaatctaaaacaggaacctggacagtgggtcctacacagagacagaggagagtgggccagggcaaggtgggagtgggagaagtctgagatgaaaacatcagaatggagcagaggcaagaatgagatttcacctgggaggttatgggtggggaaagatacgaaatacaggagacaggagagggaagatgggcggaacacagggtgagaatgagattccagggaagcctagctcagctttaacccaatttgtccattcattggagagagtatctatggccgtgttcaaaccctggggtgctctgttccaggggagatcatcgggggcacagaatgcaagccacattcccgcccctacatggcctacctggaaattgtaacttccaacggtccctcaaaattttgtggtggtttccttataagacggaactttgtgctgacggctgctcattgtgcaggaaggtgagacaacagggtctatttatctccaaatgggagatgaacaaccagagtagcatccaggaatacacctgcactggggactgaagagggggtcctgggtcttgtcaactttcaggagagggaagactttgggctgaaagactttagtctgtgtttgaatagttccttgagcctcagtcactgagctaagctcccttcggaggaaaaggaggtcctgtccgaaggtccctcttgttgcagtagcacccctcacccctacccaactcaagacacacggctcacttttcagggccccacccagtctcagggccacttcctctatggccttttcaagaacactggctctagttctcagggtcctgaacccatcattttatgggagcagagaacaggtctacataagacccccactttcccgttttaactgatatctcctgcttcaggggctggccctcatgcagggttccctgaattaggaagtgtgaaccctgtcccctgagtcctccctggcctgttcagtccccagcaattccaggggtcgtagaaattgtgtctgtttcctgagaaagctctttcatgagttaagcctgagccctcaaatgccacaagtggcccatgaaaagggagatgggtagagtccggcnacccagtgacagagtttagtcctcttttctcagaatgagctcacctcagaagaaaccccaagccatcactgtcgcctccttttccttccttcttcctcacagcaggtctataacagtcacccttggagcccataacataacagaggaagaagacacatggcagaagcttgaggttataaagcaattccgtcatccaaaatataacacttctactcttcaccacgatatcatgttactaaaggtgacaacacctctcttctccctttccacttcccattctcctaagcttctccttcaggtcctcattgccctgaatttttcttaggacttggctataacatgaagctactcaccctgtccctccctgatcacctccaactgtccagagcccatttcgaggactgacagtccttcattcccttcacagttgaaggagaaagccagcctgaccctggctgtggggacactccccttcccatcacaattcaactttgtcccacctgggagaatgtgccgggtggctggctggggaagaacaggtgtgttgaagccgggctcagacactctgcaagaggtgaagctgagactcatggatccccaggcctgcagccacttcagagactttgaccacaatcttcagctgtgtgtgggcaatcccaggaagacaaaatctgcatttaaggtgatcctccaactaggtttcctctccaaaactcactgttcagggacctgaatgctcttagaaggagatggggtcagcaggttgtcagtcaggtgacagggtgagcatcacaggaattgctgtcctcccgtggtccaagacagcctctgaccatccattccagtctactgcactgggggcatggggtgactgtggagaatgtggatgacggtcccaagaaaggaagaaggggcatcagaactagatgtataagtgaggagctccacctcctgggtctgactttaggtctcactgtgactccaagctggctggcagacaggagtggaggacttcccgggctcaccttcttctctctctcctccccctacagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaatcctggatcctgagccagcctgaagggaagctggaactggaccttagcagcaaagtgtgtgcaactcattctggttctacccttggttccctcagccacaaccctaagcctccaagaggtctcctacaggtaacagaactttcaataaacttcagtgaagacacagcttctagtcgtgagtgtgtgtccctctctgctgctctcttctcctgcacatgtgacctgattcccagcccaagcaccaaggacaccgctcctgtcagccaacaaatatccattgagcgacacctgtgtcccaggtgctgctctgggccctgggagaagtgcatcagtgggcttggtagtagagggtagggatggagtgaagggtaggcaggaagaatgtccccaggctggtaggaggtggggtggggggtttcagtctcaaaactcccatgaaaaccagagagaagtttcagaactccacccaagaggctgggtttctagggcccagagctgccctcccccaccctagaatgggctataaaagtcccttcccagctacgtccagagaagagctggaggaagtgagaggtcggctgggggtcctcaaagtgagaggggagcagaggatcctcccgtgcaggctgtggatgtcactcacttcccagctggtgaagcctcgctgcagagatgcatctgctcccagccctggcaggggtcctggccacactcgtcctcgcccagccctgtgagggcactgacccaggtaatagtcccctagacaggcaaggaggagggaggggaaatggaaggggaagcacttgggtcttggagggggtcttgtggcttgctgaaccctgagtccccatctctttgaacagcctcccctggggcagtggagacctcggtcctgcgagactgcatagcagaggccaagttgctggtggatgctgcctacaattggacccagaagaggtggacttgggtctgggggctgcatgggcctgggaggatcagttaataccttgtggggtcagggagcccatgtcccgtgctgatgttatttccccaccaggtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaaggtacctaccctcagccaatctcccatgcccttgtgtggcctcccccaaaggcaaggtgctgggggtggggatctggaagactggagcaccatccttaaggagctgcctgtggagctagggtatgagacagagacacaagcactgtctcctcttccatctcagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtcagacagggaggaaggtggtgtcttcccaggaaacagccatccctggggtcccaactgggaagcaatggtgggatgtggtgaaggtacatggtttgggacctcagtattaggcacaccataagcatggatctgtgcactgaagagatggaggtccagtgagggccaggagtttggcccaccccgtctctcccatccccagccctgggtctaccctggtagaaagacatttctctgggaaaggctgcagtaaatctgagcttggggttttcaaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccaggtaaggagctctgcatcccagcatcccccctttgtatctccacccaccaatagtaaattaatgttgtcacatttgacgtgatgacaataaagaatatgtctgagccaccctttgaaaaggcaagggtatgggtgagtagcctctggggaatgttcctcctgtcttcccttccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaaggtgaccaggttttccagggggcaaatgggggtgagggtggggagcatgccctcccctaggtggtccagctgcttcatgtctctccagaactctgtttcctgacaaacgttactaacatacccgactggcttgtccagctctgggctagcttggcatcatgtgataacccaagtagcttcccagaggctggtccaatctgtgctgctcacattccctgccaccagggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccaggtgagggggctgtccacctcttctcccagctttgctcgggccaggctgctcaaggggttctgggaagaccctggtacccgactgcctggtaggttctggtggcagaaacgaggtgttttcaccaaaagacagcgcaaggccctgagcagaatttccttgtctcgaattatatgtgacaataccggtatcaccacggtttcaagggacatcttcagagccaacatctaccctcggggctttgtgaactgcagccgtatccccaggttgaacctatcagcctggcgagggacatgaggcttctgcaggtaaggggaggccacctccagcaccctgggctggttaagcctcacatccttccctggatggatggctgagtcctcttaggtctctaagcagagaaaacagaacttgtcactaggtactctttccaagtggcttcccaatgtgctagtttctgggctgacagtcaattccaggccctaggactttggggggaaattaggagcatccaactagaattccgtggccaggacccctgccagggcactgacccagcctcccctggggcagtggagacctcggtcctgcgagactgcatagcagaggccaagttgctggtggatgctgcctacaattggacccagaagagcatcaagcagcggcttcgcagcggttcagccagccccatggacctcctgtcctacttcaaacaaccggtagcagccaccaggacagttgttcgggccgcagattatatgcatgtggctttggggctgcttgaagagaagttacaaccccagcggtccggacccttcattgtcactgatgtgctaacagaaccacagctgcggctgctgtcccaggccagtggctgtgctctccgggaccaggccgagcgctgcagcgacaagtaccgcaccatcactggacggtgcaacaacaagaggagacccttgctaggggcctccaaccaggctctggctcgctggctgcccgccgagtatgaggatgggctgtcgctccccttcggctggacccccagcaggaggcgcaatggcttccttctccctcttgtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaagggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccagggtacaatgcttggaggcgcttctgtgggctctcccagccccggaatttggcacagcttagccgggtgctgaaaaaccaggacttggcaaggaagttcctgaatttgtatggaacacctgacaacattgacatctggattggggccatcgctgagcctcttttgccgggggctcgagtggggcctcttctggcttgtctgttcgagaaccagttcagaagagccgagacggagacaggttctggtggcagaacgaggtgttttcaccaaagacagcgcaaggccctgagcagaatttccttgtctcgaattatatgtgacaataccggtatcaccacggtttcaagggacatcttcagagccaacatctaccctcggggctttgtgaactgcagccgtatccccaggttgaacctatcagcctggcgagggacatgaggcttctgcaggagtctatcccaagtctccaacttttggagacaaggggaaggggaggaccatgaggctgccttgtctccctggagcaagtgcaggctcgtgacgcttctgctggctacagctcagagctgggttccccagccaggagtgaaggctgggggctcctatcagcaatggaccttccgccttgggagcctcttaggtattaggctatgaatcagcgccacgtgcaaaggcttgggagccaagccatgtggtcttgcaccccaggcaagaaaagtcagctggagggtttacagcactttctactgtttcccagccctccctcccctccctcaccatgactaagagaccactcggtcctagcctccagacaccccacaatactcctctgagcctgaggccaggcagcatgctctgcttctaccaataaagcactgccggaattccatatgtatgggaatactgtatttcaggcattataaggaatgaaattataggccgggcattgtggctaacccttgtaatcctagcactttgagaggctgaagtgggcagatcacttgagcttcagagttcgagaccagcatggacaacatggtgaaacccagtctctaccaaaaacacaaaaatattagctgggtgtggtggtgcatgcctgtagtcccagctactcaggaggctgaggtgggaggatcgcttgagcctgggaggcagaagttgcaatgagcagagatcgtgccactccgctccagtcttggtgacagaatgagactccatctcaaaaataaataaataaataaataaaataaatgaaatgaaattataagaaattaccactttttcatgtaagaagtgatcatttccattataagggaaggaatttaatcctacctgccattccaccaaagcttacctagtgctaaaggatgaggtgttagtaagaccaacatctcagaggcctctctgtgccaatagccttccttcctttcccttccaaaaacctcaagtgactagttcagaggcctgtctggaataatggcatcatctaatatcactggccttctggaacctgggcattttccagtgtgttccatactgtcaatattcccccagcttcctggactcctgtcacaagctggaaaagtgagaggatggacagggattaaccagagagctccctgctgaggaaaaaatctcccagatgctgaaagtgaggccatgtggcttggccaaataaaacctggctccgtggtgcctctgtcttagcagccaccctgctgatgaactgccaccttggacttgggaccagaaagaggtgggttgggtgaagaggcaccacacagagtgatgtaacagcaagatcaggtcacccacaggccctggcagtcacagtcataaattagctaactgtacacaagctggggacactccctttggaaaccaaaaaaaaaaaaaaaaaaaagagacctttatgcaaaaacaactctctggatggcatggggtgagtataaatacttcttggctgccagtgtgttcataactttgtagcgagtcgaaaactgaggctccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaaggtgagttgcccatatgtatgggaatactgtatttcaggcattataaggaatgaaattataggccgggcattgtggctaacccttgtaatcctagcactttgagaggctgaagtgggcagatcacttgagcttcagagttcgagaccagcatggacaacatggtgaaacccagtctctaccaaaaacacaaaaatattagctgggtgtggtggtgcatgcctgtagtcccagctactcaggaggctgaggtgggaggatcgcttgagcctgggaggcagaagttgcaatgagcagagatcgtgccactccgctccagtcttggtgacagaatgagactccatctcaaaaataaataaataaataaataaaataaatgaaatgaaattataagaaattaccactttttcatgtaagaagtgatcatttccattataagggaaggaatttaatcctacctgccattccaccaaagcttacctagtgctaaaggatgaggtgttagtaagaccaacatctcagaggcctctctgtgccaatagccttccttcctttcccttccaaaaacctcaagtgactagttcagaggcctgtctggaataatggcatcatctaatatcactggccttctggaacctgggcattttccagtgtgttccatactgtcaatattcccccagcttcctggactcctgtcacaagctggaaaagtgagaggatggacagggattaaccagagagctccctgctgaggaaaaaatctcccagatgctgaaagtgaggccatgtggcttggccaaataaaacctggctccgtggtgcctctgtcttagcagccaccctgctgatgaactgccaccttggacttgggaccagaaagaggtgggttgggtgaagaggcaccacacagagtgatgtaacagcaagatcaggtcacccacaggccctggcagtcacagtcataaattagctaactgtacacaagctggggacactccctttggaaaccaaaaaaaaaaaaaaaaaaaagagacctttatgcaaaaacaactctctggatggcatggggtgagtataaatacttcttggctgccagtgtgttcataactttgtagcgagtcgaaaactgaggctccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaaggtgagttgccctgctttaaaatctctcggccacctttgatgaggggactgggcagttctagacagtcccgaagttctcaaggcacaggtctcttcctggtttgactgtccttaccccggggaggcagtgcagccagctgcaagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgatccatagttttcagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggtagaggcctggaaaacccatgtctggcaggacgagaagcggagacccaagagaagagagattccattgaaagtcttggtcaaagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggttgtctgcatggataagtacaggctgagctgcctggaggaggaacggctgctgttggtggtgaccagtacgtttggcaatggagactgccctggcaatggagagaaactgaagaaatcgctcttcatgctgaaagagctcaacaacaaattcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggcagcctgtgagacgtttgatgtccgaggcaaacagcacattcagatccccaagctctacacctccaatgtgacctgggacccgcaccactacaggctcgtgcaggactcacagcctttggacctcagcaaagccctcagcagcatgcatgccaagaacgtgttcaccatgaggctcaaatctcggcagaatctacaaagtccgacatccagccgtgccaccatcctggtggaactctcctgtgaggatggccaaggcctgaactacctgccgggggagcaccttggggtttgcccaggcaaccagccggccctggtccaaggcatcctggagcgagtggtggatggccccacaccccaccagacagtgcgcctggaggacctggatgagagtggcagctactgggtcagtgacaagaggctgcccccctgctcactcagccaggccctcacctactccccggacatcaccacacccccaacccagctgctgctccaaaagctggcccaggtggccacagaagagcctgagagacagaggctggaggccctgtgccagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacggagatccacctgactgtggccgtggtcacctaccacaccggagatggccagggtcccctgcaccacggtgtctgcagcacatggctcaacagcctgaagccccaagacccagtgccctgctttgtgcggaatgccagcgccttccacctccccgaggatccctcccatccttgcatcctcatcgggcctggcacaggcatcgtgcccttccgcagtttctggcagcaacggctccatgactcccagcacaagggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaagagccagaagcgctatcacgaagatatcttcggtgctgtatttccttacgaggcgaagaaggacagggtggcggtgcagcccagcagcctggagatgtcagcgctctgagggcctacaggaggggttaaagctgccggcacagaacttaaggatggagccagctctgcattatctgaggtcacagggcctggggagatggaggaaagtgatatcccccagcctcaagtcttatttcctcaacgttgctccccatcaagccctttacttgacctcctaacaagtagcaccctggattgatcggagcctcctctctcaaactggggcctccctggtcccttggagacaaaatcttaaatgccaggcctggcgagtgggtgaaagatggaacttgctgctgagtgcaccacttcaagtgaccaccaggaggtgctatcgcaccactgtgtatttaactgccttgtgtacagttatttatgcctctgtatttaaaaaactaacacccagtctgttccccatggccacttgggtcttccctgtatgattccttgatggagatatttacatgaattgcattttactttaatcgaattcccactctgctgcctgctccagcagacggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtccgaatgttagattcctcttgcctctctcaggagtatcttacctgtaaagtctaatctctaaatcaagtatttattattgaagatttaccataagggactgtgccagatgttaggagaactactaaagtgcctaccccagctc

SEQ ID NO: 3004 - DNA, 209274 bp; single-stranded, linear
cctccttcctggtctgtctgccbgbcbbbtttgggbbgtgbbcbgttttggbbccbtgtttcccbgtctctgbgctgtggcgccctgctgctctttctgcttcccttggtgggttgggccgctggttgttctggggttcttgctgccccttctgtccctgtttgctggtgtctgcgcccccbbcbgbbgbbgcbgbcbbbtttgggbbgtgbbcbgttttggbbccbtgtttcctgtgcgctcggcctggtcccgggggtctcctcttgttgttgcttgcgcctcctgctgggggtccctctgttcttgttttgggggcgggcccggccgttgtcttggtttgggggtttccgttggggttctcctggcccgggccttgcccggccgtggtcccggcttcgttcctgtctccgtctcggctcttctggggccttgcgctgtctttggtggcbccgtccbgtgbtggtgcggtbcttgtcgctgcbgcgctcggcctggtcccggbgbgcgcgcgggccgggggctgctgggggttggcccggggtgccccgccgctgggtgccctcgtcctctgcggtcgtgtctcctggctctggttccccgctgcgcccgttgtcctctggggtggccttcgctcccgggtctggttcttgtgttgggggtccctttttgggcctgttgtggcgtggcttgtgtgttcggtttctgccctgtcctccggcgtccccggbgcctccccggggcbggbtgbcttttgbgggggbcbcbgbtgtctgggcbttgccbggtcctgggbbcbgbgccccgbgcbggbccbggbgtgcgggcbgcgcgggccgggggctgctgggbgccbtbgcgbggctgbgcctcttttctgtttttcccctctgcctttgtttgggttcgcttcctttctgcttcttccctgtgtctcctgtctccgcttttttcttcgtctttgttgttttctcttccttgctgbgcbbgbtbtctbgbttctggggtggtctcgbttttbbbbgcttgbgbbgctgcbbbcbttbtccbbbgtbtbtttgbggctccbbggbtcbcgbccbtcttcccbggcbttttbbgttgctgtcgtbbgtgbgbgctgbgbgbbbctgtgbbgcbbtcbtgbcttcbbgbgttcttttcbcccgttcttggcttcttctgtccgttggcttctcgttgtccctgtgggcttctcgttgtccccccttcgggggctggtggggccgtccttgcctgctgggttcttggcttcttctgtccgttggcttctcgttgtccctgtgggcttctcgttgtccccccttcgggggctggtggggccgtccttgcctgctggttttctctttcgctttcttttcgtctcctgttcctccttttttgctgttttttctccttcttctctcctttcttttcttttctctttcgctttcttttcgtctcctgttcctccttttttgctgttttttctccttcttctctcctttcttttcctctgtcttgttctggtccttcgtggggctctgtgtcgcgtgggtgcggccgtggccggcggbccbggbgttggbgcbggbgcbggbcgggcbggcggctcbtgtttggbtcggcbggbggcbctcctctggttggcttccttcgccggcbcbtgctbgcbggbbgbbcbgbgggggbbgcbgttgggbggtgbgbcccbttbbtbggtgtcgbtccctgtttcccccctttcgttctgcgtttgcctttggcgttttttgtttgttttctctctccgtctttcttctcccctgtgggbbtttctgtggggbtggcbtbcbcgtbggcbgctccbbgbgctbgcbbbctcbbbtgcbgbbgcbtcctcbtggctctgbbbcggtgggaatttctgtggggbtggcatacacgtaggcagctccaagagctagcaaactcaaatgcagaagcatcctcatggctctgaaacggggggtggcttcctgccgcgtctctgggccgtcccgtccctcggccccgcgccgcgctcggctcctctccctctggcccggctcggggcggggcggggcggtgggcgggcggcgctgccctgcgcgcggcgctggcccctgctggccgtcggctgcgcgctgctggctgccctgctggccgcgccggggcctgtccgcctctgcgggcgctgtctcctggcttgtcttccggctcttctgctggggtggggctgggcggccggcccggtgctggggctcctcgggggggggggctcttccgggctgtctccctccggggcgggggtttctggccgtgggggtcttgcctggcctccgggctcctgcttgtcttgccttccttctctggtcggttgtggctcggggctccgtgggtccctggcgcccgtttgtgttttgtcttttcccctggcgtccctgtgcccctctcctctccttcctctgcttctcgctctcctttgtggggccctccctgctgctcttggttttgggctttttttctcttcctcctttttcgtgcgtgggcctccgcacgcctcttgccacctcctgcgcagggcagcgccttggggccagcgccgctcccggcgcggccagcagggcagccagcagcgcgcagccgacggccagcatgcttcctcctcggctaccactccatggtcccgcagaggcggacaggcgcbcgcctcttgccbcctcctgcgcbgggcbgcgccttggggccbgcgccgctcccggcgcggccbgcbgggcbgccbgcbgcgcgcbgccgbcggccbgcbtgcttcctcctcggctbccbctccbtggtcccgcbgbggcggbcbggcggggtggbbbggtttggbgtbtgtctttbtgcbctgbcbtctbbgttctttbgcbctccttggcbbbbctgcbccttcbcbcbgbgctgcbgbbbtcbggbbggctgccbbgbgbgccbcggccbgcttggbbgtcbtgtttbcbcbcbgtgbgbtggttccttccgggcttgtgtgctctgctgtctcttggttccttccggtggtttcttcctggctcttgtcctttctcttggcccttggccgggbgtgggggtcctggbcggcbctgbbggcbtccbgggctcccttccbgtccttcttgtccgctgccbgcbccccttcbttccbgbggctgbtggcctccbccbgggbcbtgbttbggtbgbbbctbggbggccggcctccbccbgggbcbtggtccttcttgtccgctgcctctctggggttttcggtctgggtgggctttcctcctggggctgctgctgggctcttctttttgtttctggcctggtgctctctcgtgccctttcccttgggtgtcttgtttttgtggcctccbccbgggbcbtggtctttgtttctgggctcgtgccccbtcccggcttctctctggttccgtcctctgtggtgtttggccctgcttccttttgcctgttgagggggcagcagttgggccccaaaggccctctcgttcaccttctggcacggagttgcatccccatagtcaaactctgtggtcgtgtcatagtcctctgtggtgtttggagtttccatcccggcttctctctggttccaagggagbgggggcbgcbgttgggccccbbbggccctctcgttcbccttctggcbcggbgttgcbtccccbtbgtcbbbctctgtggtcgtgtcbtbgtcctctgtggtgtttggbgtttccbtcccggcttctctctggttccbbgggbgggcbcggggcbgtgggcgggcbbtgtbggcbbbgcbgcbgggtgtggtgtccgbggbbtbtggggbggcbgbtgcbggbgcgcbgbgggcbgtbgcbbtgbggbtgbcbgcgbggcgtgccgcggbgbccttcbtggtbcctgtggbgbggctgtcggbgggggtgtggtgtccgcttggcggttctttcgggtgtttcttctctgggttggcctgctgctcgtcgtggtcgctccgctcccgggttcgtctcgctctgtcgccccttccttccttgtcgtgttcctcccttccttgcctctgbtgtttgttbccbbbgcbtcbbgbbtbgctttgctbtctbbggbtcbcbtttbgbcbtbggbbbbcgctgtbggtcbgbbbgbtgtgcttbccttcbcbcbgbgctgcbgbbbtcbggbbggctgccbbgbgbgccbcggccbgcttggbgtcbtgtttbcbcbcbgtgbggtgctccggtggctttttgcttgtgtgctctgctgtctctgttccttccggtggtttcttcctggctcttgtcctttctcttggcccttggccccttgbgcbggbbgctctggggcbgggbgctggcbgggcccbggggggtggcttcctgcbctgtccbgbgtgcbctgtgccbcbgcbgcbgctgcbgggccbtcbgcttcbtggggctctgggtggcbggtccbgccbtgggtctgggtggggctgggctgcbggctccgggcggtccbgccbtgggtctgggggctgggctgcbggctccgggcgggcgggtgcgggctgcgtgctgggggctgccccgcaggccctgcggtccbgccbtgggtctgggggctgggctgcbggctccgggcgggcgggtgcgggctgcgtgctgggggctgccccgcaggccctgcgcbccgcctggbgccctggggcccccctgtcttcttggggbgcgcctcctcggccbgctccbcgtcccggbtcbtgctttcbgtgctcbtggtgtcctttccbggggbgbgbggggctggtcctctgctgtccttgctggtgctcbtggtgtcctttccgccctggggcccccctgtcttcttggggcctcttccctctgggggccgtctctctccctctcttgcgtctctctctttctctctctctcttcccctttcccgctctttctgtctcggtgtctggttttctctctccgctggctgcctgtctggcctgcgctcttggcctgtgctgttcctcctccggttcctgtcctctctgtctgtcgccccctctggggtctccctctgggtggtggtcttgttgcttgggctgggctccgtgtctccbgtgctcbtggtgtccgctgbgggbgcgtctgctggcgctggtcctctgctgtccttgctggtgctcbtggtgtcctttccgccctggggcccccctgtcttcttggggcctcttccctctgggggccgtctctctccctctcttgcgtctctctctttctctctctctcttcccctttcccgctctttctgtctcggtgtctggttttctctctccgctggctgcctgtctggcctgcgctcttggcctgtgctgttcctcctccggttcctgtcctctctgtctgtcgccccctctggggtctccctctggcgtggtggtcttgttgcttgggctgggctccgtgtctccbgtgctcbtggtgtccgctgbgggbgcgtctgctggcctgctgbggcttgggtctccgggcgbttctctgcbgbbgbtgctcbbbgggctccggcbgttcctccttgbtctggtcgctgtcgtbccbgtcggbccbgtbbttcbgbtcbtcbttggctcctbtttcttctgcbbbcbgctgbgtggbgbcbbgbbbbbbgbctgccbbggccbcgbggbttttcbtgttggbttttgcgbcggbcbgtcccgcggggtgctgagtttctctggttcctccgbgcgcbcgtggtcgctccgcgtttctctggttcctccggtcccgcggggtgctgtctggtcgctgtcgtggcttgggtctccgggcggtttccttccttttccgccggcccttctcactggaggcaccgggcagtcctccatgggagggttgggcttggccggggctgcccggtgcctcctcttggctggtccctcgttgtccttgggccccgctcccgctgctcggcctccgtgttctttggcctcttgctccgcctgctgtcttgtcccgtcccctcctcgcttgcgtttccctcttccttgtcttccaggccttcctccgcttccgctgctggggcccgcgccgggggggcgctcggctccgcggcttcctccccggctggggggtcctggtctccggggcctgcggctcgcgggctcggggctgcgtgcgccgcgcgcggcgtccgcggtgggtggcgctgtcccgccgtggtgtgtctccgttctcgtcctgcgccgtcctggtctgcccgtggggtcctgggcgtggtggggggcgtctggtgcctcgtctgccccgtggggcttcgggctcggggctgttcgtcccccctgccgctctgtggcctccggggctcctcgttttcgctgcttcgggtgtccttctcggcgtgtggccccgggtcccggccctgctgggctgggcggggtcgctgccctgggcttctggcccgtctggttgtctgtcggtgcttgtctcgggtttctggcctctgtgctgggcgcttctctgcctcctgctccgccctcctggtggctcggctgggggtgcccgtgcgggggtgggtgtggggtgttttcggggtcctccccttcccgtttcatcttggctttatcctctccccttgttcctcccctctcctgctctggrgtctcctcttccctccctcccctgccgtgttgtctgtgggtgtcgtttcgctcttgttgccctgggcccttccctgctgggggggagtttcatcttgggtttcbtcttggctttbtcctctccccttgttcctcccctctcctgctctggrgtctcctcttccctccctcccctgccgtgttgtctgtgggtgtcgtttcgctcttgttgccctgggcccttccctgctgggggggbgtttcbtcttgggggggbgtttcbtcttggctttccgtgttgtcbgtggtgctgcccgtttgbggtbtggcgctccbccbbttcccttttctccttgttttccgtttctcttgccgtctgtggttgctcagcctccaaaggagccagcctctccccagttcctgaaatcctgagtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactttttataagcattcttttaataaaggaaaattgcttttgaagtatatcctttaagtcaatggactttgcatcagtcacaccatcttttgttactttggacttccccagctatgttcaataattactgttcttcccttgggccccattgtaatggctacagcctcgacaaaaagtctacactttgaagcattaaggctcggacatcagcaccaaattttacatctttaccatcacttcaagtgaggtgaggagccagtagcctggacactggtctcatctggtgaaagactgtgggtaatggaagcatttctgtggggtgctggcaggacatgtgcatggcgaggcaggtcatcagcagcaagtgagagctgcctcttactttctaaaggtgacatagcaaatatacaaaaaaaaataaataaattattaatttaggtagagcacataaaggctttatttcatattccatttctctgtatgctttcttcaccaggaagaaatagttttagtgtcaggaatgaatgagtctgcccctcaattccagcctgctcaacacacaaggaaacaaagccctgacaatcagagtgactccctggtgactaagctcccagtcctggatgcatatttgtttagcagttctgacagcatttgacccagccctctctctgcatatcccatcagaaccttcttttttttttttttctttgagactgagtcttgctctgtcggaagcgactcctgtgcctcagcctcccaaatacctggaattataggcgtaagccatcatgcctggctaatttttgtatttttcatggagatggggttttgccatgttggtcaaattggtctcacactcctgacctcatgtgatccacctgcctcagcctcccaaactgctgggatgacaggtgtaagccaccatgctaggctcagaaatttccttttataaaaatgtcattaaggatcttggctgcacaatatcgttaccagcttcctttaaatccacttctggcctgccaggaatcaggttcttcagaacctgacattttaaatgaagaggtcaggcagttcatgaggaaagcctcattgtccccatgtctctgtcactgctgcacccctgagacatcacagacatggacactggggcctgcttgtttctcaaactgcccttagatcgaaagagggaggaaccaggatgaatgccactcattttcccaagaaaggccctctcctgagtgcccgggatggggctctgtccattgcctggggccgccaattgctactctgggttacggaggaaggacagggtcctgagagacaccagagacctcacacagccctgaaaacatggggctccttcataagtgtttcccatcaccaacagggagaccacgtggaggccttgcagccccactcggtgcttctccaccaaatcccaagggcagtgacgctgacgtctgtggaaagcagagaaagccctggctcccaaagccctgaagtccctgtggagctgacattccctgagtgacggtgtgaatggaaggaactcaagtgcgggtggtaggccacctcctggcccaggcctgggtgaactctgaggggacacatgtagtcacaatcccatcctcccattctccttctcagaggaaggaagtgggcatccatctgcctcatctctctcccgtggggaagatggggagtttcaggggaactttcacataaatttcaccagctcagatctcctgtgaggatggggcccaccatgctcccggtgctgccagaggccctgagcccctcccagggtccctgggtttgagccagccctgtatcatccccaggagctgaatgtcagagcaatggatagaattagatggaaagagctctcaatttgacctgagactgtccccagatactcaggaaaaacaggacgtcgcacagagtgggcagcaggtgagtggcaggttataggtcctgagtttgagtttgttctcacgtgagacagacccagcccctcactccattcacacactgggttttaaatggtgcaagataggagcaattttctggtcccaagagcaggaggaagggattttctggggtttcctgagtccagatttgcataagatctcctgagtgtgcattgttctttgaggaccattctctgactcaccaggtaagtggctgaattctaacctctgtaatgagcattgcacccaataccagttctgaactctacctggtgaccagggaccaggacctttataaggtggaaggcttgatgtcctccccagactcagctcctggtgaagctcccagccatcagccatgagggtcttgtatctcctcttctcgttcctcttcatattcctgatgcctcttccaggtgagatgggccagggaaataggagggttggccaaatggaagaatggcgtagaagttctctgtctcctctcattcccctccacctatctctccctcatccctctctctccttcctctctctgtgtgtcccctccatccttttctcctgcttctctctcttcttccctctctctcttttttctgtctttctttttcctctctccctagagcatgtctttctttctttctctttcctttcttctacccacacttttagactgaatgccctatttaattgaacaaagcattgcttccttcaatagaaaaggagtttgagaacccaatggacacctcactcgttcttctaagccaatatgaaggagcccagtagcttgtaaatatcatctcttcactgctttccatgctacaactgctgagactatggttgaaacctgttaggtgactttttaaataaaaggcagaaattttgattttatctaaagaaagtagtatagaatgtcattttctaaatttttatatttaaagggtagatactgcaacctagagaattccagataatcttaaggcccagcctatactgtgagaactactgcagcaagacactctgcctccaggacttttctgatcagaggccctgagaacagtccctgccactaggccactgcaggttcacaggacagggtacagcccattgaaacctacttttaaacctggatgcctaaccttcattttctccttgatattatgaaaataaaataaaaaccatgaaaggataaaagagggagagtggaagggaaggatggagaaagggaaaaagaaaatttgagagtaaatcctaaaacaattaatctaatagatatcatcttgtgaaatcctcattttaccaatcttatttatgagtcctgggttttgtgagaacaatggggttctgagaggcaccagagacctcatgttttccaaaacctagaacagtataatgaaggaaggcggggaggcagggaggcagggaggcagggaggcagggaggcgggcaggtggggagggagggacggaaggagggagggagggagggagggagggagggagggataaaaaaagaagaatgaggttgaaaccaggacttagatattagaaacaagccattacaaaatttatttctatggttaattgtggttttcaactgtaagttacttggtgttaatttcctattaaacaatttcagtaagttgcatctttttatcccatctcaggtcaaatacttaacagactaaatgatttgaaaaagcaaaagtttactggcttgtgtgtgttaaaatggaggtatggtggctttgatattatcttcttgtggtggagctgaattcacaagagatcgttgctgagctcctaccagaccccacctggaggccccagtcactcaggagagatcagggtctttcacaatcaggttctacaaaaataaacatccccccaaccacagcagtgccagtttccatgtcagaaacttagatccaaatgactgactcgcgtctcattatcatgatggaaaagcccaggcttgagaaagaagcccgctgcggatttactcaaggcgatactgacacagggtttgtgtttttccaacatgagttttgagttcttacacgctgtttgctctttttgtgtgttttttccctgttaggtgtttttggtggtataggcgatcctgttacctgccttaagagtggagccatatgtcatccagtcttttgccctagaaggtataaacaaattggcacctgtggtctccctggaacaaaatgctgcaaaaagccatgaggaggccaagaagctgctgtggctgatgcggattcagaaagggctccctcatcagagacgtgcgacatgtaaaccaaattaaactatggtgtccaaagatacgcaatctttatcctagtaattgtggtcattgggtgatgttggtttgggcaggccatctctaatatccttgaaacacctttttctgctctccaggaaggggtcagggctgccacagcggggcttggagtgctttccagggtcacaggcatctgtattctttggattccttgaccttccccatttattcccggcattttcctaaaacgtgtgctttgctcctcctgcatcctccccttgcatgccctcacctaccccacatcttccctaaaaaaagcaagcccaactcaaagaccagttccctcatggaatcatagtggatctgccaagggaggggatgcccagtcctctgttcttcacaagactcccttcttctggctaaggtttcttatgcaattatctgcagtggtaaaaagattctatatctgctgtttgatgaatgcagcacccactagccacatagtgctcgtgagcacttgcaatgcggctagggtgatttcaattaacctaaaagagaacagccacagggagcatgtggctgccatattggatggtgctgctttgagaacaaaatgagagaaatgaagcctctatttaccttggttggcggaacacattgaagggactctgtattgataccaggcttcaaactttgggaagtgtactggccaacttaaacacatccacaggagaatgaagaggtttgggaagggaccagaaaccaggcattgaggacaatgagaagagtttttcaaaagtggaattactgcaaaaagtggaaaaatagcctttggatggaagttactgatgagacaatttccatcggtgtgaaagccatctttccaacagagatctgcaacatgagaatgtactgtctcctagggtagcgatggcctcttgtattagtccgctcaggctaccagatttatcgtttaaactgcccataaacagaccaggcagtttaaacaacagaaatttatttcctcgcagtcctggaggcaggaagtctgcgatcaaggtggaagcagggttggcttcttctcaggtgtctgtccttggctggtagatgaccgccgcctccctgggtcctcacatggtctttcctctgtgtgtgtctgtcccaatctcttcttataaggatgcaagtcttatggatcagagcacaccccaatgaccgtgtttaacttgaatcacctctttaaagtttctctctccaaatacaatcacctcctgaggcactgttagggcttcgacacaggaattcttttcctaggggattcagttcagtccaaaacgcctaccagtggagacttgcaacatggcggcctgctggtccctcgccaggaatatcacaggcgactgttccctgttgcatggaatagaaggctattccagagtactgtctctatttatcagatctgggatactgggagaagggcaaaataaagtccaagtagaaaaaaaaactatgaaagttttagagagtaaccataatttcagcccgatgtgaaacgatcctagatttcagctgaaatagtgatgtgggaagtgagggggccgggattcaaggcagagggaacagcgtaactgaaggcatggaaggagggaagtgtaggctgtgtttgaagagtggcagctgcttccacatttctaaaacacaggatgtgattttggggtgtgttgagacaaggcagaaaacttgtttggaaaaataacttgaattccctgcacatttaaaatctctcagcagaagaaaaccccactcagaaccccactgttcattccttggcttgtatttggscacagctggcatagccccagactgagtaagctcttcagacacctcatttcatgagtagccccaaagatcaatcatgggccaatttcttggaagagaagactctccggtgttttgcagttatttgttctgctttcgcgagatgttctcaaatcgttgcagctacaagccatgagtctgaagtgtttgtgttccctccttacaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgagagtgaccagaagaaatgacgcagaagtgaaatgaactttttataagcattcttttaataaaggaaaattgcttttgaagtatacctcctttgggccaaaatgaatcttgtgtctcaattggaagaggtaaagaagtagggggttagggtgcatgggttggaacgtgagacaggtcgaaccacaaagcctgcctggaaaaggggagtgacgtcctaggcttcagtgatgtcacctccactttgtttgatccacaaaccaacaggtgactgattttggtcagctcagcctccaaaggagccagcctctccccagttcctgaaatcctgagtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaacttgaattcacatttctcaccttttgatgtattaagaaagtatggagaaatatatcctctatcaaattttcatgccttcaataatttctaattcatcagtcagtgtttttccatcctttactgtgatgatgccctttcttccaaactttttcattgcatcagagatgatgttaccaatttctttgtctccatttgcagaaattgtagcaacctgtgcaatttcttcaggtttggtcacaggtttagactgctttttaagttcagcaattacagcatcaacagctaacatcacacctctcttgatttccactggattagcacctttgctaaccttctggaaggcttatttggaaatagagcataccagtacagcagcagtgatagtgccatcccccagtctctccatttgtgttattggcaacatcttggacaagtttagctccaatgcttttatatttatcctttaagtcaattgactttgcatcagtcacaccatcttttgttactttgggacttccccagctatgttcaataattactgttcttccctttggccccattgtaatggctacagcatcgacaaaaagtctacactttgaagcattaaggctcagacatcagcaccaaattttacatctttaccatcacttcaagtgaggtgaggagccagtagcctggacactggtctcatctggtgaaagactgtgggtaatggaagcatttctgtggggtggtggcaggacatgtgcatggtgaggcaggtcatcagcagcaagtgagagctgcctcttactttctaaaggtgacatagcaagtatacaaaaaaaaataaaatattaatttaggcagagcacataaaggctttatttcatattccatttctctgtatgctttcttcaccaggaagaaatagttttagtgtcaggaatgaatgagtctgcccctcaattccagcctgctcagcacacaaggaaacaaagccctgacaatcagagtgactccctggtgactaagctccagtcctggatgcatatttgtttagcagttctgacagcatctgacccagccctctctttgcataccccaccagaaccttctttttttttttttttctttgagactgagtcttgctctgtcggaagcgattcccgtgcctcagcctcccaaatacctggaattataggcgtaagccatcatgcctggctaatttttgtatttttcatggagatggggttttgccatgttggtcaaattggtctcacactcctgacctcatgtgatccacctgcctcagcctcccaaagtgctgggatgacaggtgtaagccaccatgctaggctcagaaatttccttttataaaaatgtcattaaggatcttggctgcacaatatcgttaccagcttcctttaaatccacctctggcctgccaggaatcagggttcttcagaacctgacattttaaatgaagaggtcaggcaggtcatgaggaaagcctcattgtccccatgtctctgtcactgctgcacccctgagacatcacagacatggacactggggcctgcttgtttctcaaactgcccttagatcgaaagagggaggaaccaggatgaatgccactcattttcccaagaaaggccctctcctgagtgcccgggatggggctctgtccattgcctggggccgccaattgctactctgggttacggaagaaggacagggtcctgagagacaccagagacctcacacagccctgaaaacatggggctccttcataagtgtttcccatcaccaacagggagaccacgtggaggccttgcagccctactcggtgcttctccaccaaatcccaagggcagtgacgctgacgtctgtggaaagcagagaaagccctggctcccaaagccctgaagtcctgtggagctgacattccctgagtgacggtgtgaatggaaggaactcaagtgcgggtggtaggccacctcctggcccaggcctgggtgaactctgaggggacacatgtagtcacaatcccatcctcccattctccttctcagaggaaggaagtgggcatccatctgcctcatctctctcccgtggggaagatggggagtttcaggggaactttcacataaatttcaccagctcagatctcctgtgaggatggggcccaccatgctcccggtgctgccagaggccctgagcccctccagggtccctgggtttgagccagccctgtatcatccccaggagctgaatgtccgaacaatggatagaattagatggaaagagctctcaatttggcctgagactgtccccagatactcaggaaaaacaggacgtcgcacagagtgggcagcaggtgagtggcaggttataggtcctgagtttgagtttgttctcacgtgagacagacccagcccctcactccattcacacactgggttttaaatggtgcaagataggaggaattttctggtcccaagagcaggaggaagggattttctggggtttcctgagtccagatttgcataagatctcctgagtgtgcattgttctttgaggaccattctctgactcaccaggtaagtggctgaattctaacctctgtaatgagcattgcacccaataccagttctgaactctacctggtgaccagggaccaggacctttataaggtggaaggcttgatgtcctccccagactcagctcctggtgaagctcccagccatcagccatgagggtcttgtatctcctcttctcgttcctcttcatattcctgatgcctcttccaggtgagatgggccagggaaataggagggttggccaaatggaagaatggcgtagaagttctctgtctcctctcattcccctccacctatctctccctcatccctctctctccttcctctctctgtgtgtcccctccatccttttctcctgcttctctctcttcttccctctctctctttttttctgtctttctttttcctctctccctagagcatgtctttctttctttctctttcctttcttctacccacacttttagactgagtagactgaatgccctatttaattgaaccaagcattgcttccttcaatagaaaaggagtttgagaacccaatggacaactcactcgttcttctaagccaatatgaaggagcccagtagtttgtaaatatcatctcttcactgctttccatgctacaactgctgagactatggttgaaacctgttaggtgactttttaaataaaaggcagaaattttgattttatctaaagaaagtagtatagaatgtcattttctaaatttttatatttaaagagtagatactgcaacctagagaattccagataatcttaaggcccagcctatactgtgagaactactgcagcagacactctgcccccaggacttttctgatcagaggccctgagaacagtccctgccactaggccactgcaggttcacaggacagggacagcccattgaaaccaacttttaaacctggatgcctaaccttcattttctccttgatattatgaaaataaaataaaaaccatgaaaggataaaagagggagagtggaagggaaggatggagaaagggaaaaagaaaatttgagagtaaatcctaaaacaattaatctaatagatatcatcttgtgaaatcctcattttaccaatcttatttatgagtcctgggttttgtgagaacaatggggttctgagaggcaccagagacctcatattttccaaaacctagaacagtataatgaaggaaggagggaaggagggagggagggagggaaggagggaaggagggagggagggagggaaacaaaaagaagaatgaggttgaaaccaggacttagatattagaaacaagccattacaaaatttatttctatggttaattgtggttttcaactgtaagttacttggtgttaatttcctattaaacaatttcagtaagttgcatcttttttatcccatctcagatcaaatacttaacagactaaatgatttgaaaaagcaaaagtttactggcttgtgtgtgttaaaatggaggtatggtggctttgatattatcttcttgtggtggagctgaattcacaagagatcgttgctgagctcctgccagaccccacctggaggccccagtcactcaggagagatcagggtctttcacaatcaggttctacaaaaataaacatcccccaaaccacagcagtgccagtttccatgtcagaaacttagatccaaatgactgactcgcgtctcattatcatgatggaaaagcccaggcttgagaaagaagcccgctgcggatttactcaaggcgatactgacacagggtttgtgtttttccaacatgagttttgagttcttacacgctgtttgctctttttgtgtgttttttccctgttaggtgtttttggtggtataggcgatcctgttacctgccttaagagtggagccatatgtcatccagtcttttgccctagaaggtataaacaaattggcacctgtggtctccctggaacaaaatgctgcaaaaagccatgaggaggccaagaagctgctgtggctgatgcggattcagaaagggctccctcatcagagacgtgcgacatgtaaaccaaattaaactatggtgtccaaagatacgcaatctttatcctagtaattgtggtcattgggtgatgttggtttgggcaggccatctctaatatccttgaaacacctttttctgctctccaggaaggggtcagggctgccacagcggggcttggagtgcgaattccctgtaagccctgttacaggggctgcaccccagatacaacctgacctgtgtccaaggcgggcaactcaacccttagatattgaatgggtcccatggcaccaatgcttaaacaccagcagccctcacaaccacagatcgtgttttaaggatgaggaggtagttctctggatgcacaggcttcaatccaaatgggctcatgacgccgcagcacacacccagtctgcagcctgaagagttggagcattgcattcacagaaagcatccagacatgatcatgggctcagggatacacctgttctccgatgtgtaccagtgaaggatggaaactcctatgcctcccagaaagcaccactcaagcttttgctgaatgcttctctgaaggcccacaaggctgagaggctgtgcaacaccagcagtaaagtgaatgcccagactcccacctcctttcttgggtggccatctggaaaggccactcccaccctgatggctaatgcctcagaccagttcttggcccagatgatcctagacaattgtttaagcttaaactgttcattggccaagcaaacaggtgatagtacctctggggaaccacatgccgcgtgtacatccagatctcaggagaacccaaaaatgtctgttccacatagcaacagaagcccaggtagcactcagtctcacctgggtgttctccaacatcccagctcagccaaatggctttcattagtttttatggttagaccccaggtcctcgggacactgctttagaaacacattccaaatcctcctctgtgtgcaggtggcattcctatcccaatctctttgcagggcgtatactgtgatacgcagccaggctgtcccagaggccttaaatattcccttggtgcaggtagttcagcttagccacagccaatgcatcacagggtcaactgtgttaggagccattgagaatccatagttggttgctgcctgggcctggccagggctgaccaaggtagatgagaggttcctctgtggagttctactttaacctcaccttcccaccaaatttctcaactgtccttgccaccacaattatttaatggacccaacagaaagtaaccccggaaattaggacacctcatcccaaaagacctttaaataggggaagtccacttgtgcacggctgctccttgctatagaagacctgggacagaggactgctgtctgccctctctggtcaccctgcctagctagaggatctgtaagtactacaaaacttaaactttacactgagttttcatcattgaagctatgcctccaatctgacctctgactgtggggccgccccagagggacccagcgggtgaatccctgctaggaacgtctgtccggacctctggtgactgctggggacgatggcttccagctaacttaatagagaaactcaagcagtttccttctaaatacacatgtcacatgtcctggttgacatgtccagtaagaagactatcacaggtctttggaacattcttttgagagaaacctatttaggtccttggtctgtttttcaatcaggttgtttgatttttgctattgagttgttggaattccttatgtattcagatatttgccccttctgccatgtaggttttgcaaatattttctctcattttctgggttatcttttcactcggttgattgtttcctttgctgtgcagatgctttagcgttaaatgaagccacacttgtctattttcccttttattgcctgtgcctttggtgtcatagccaagaaatcattacctacatcaatgtcaaaagctttatccttctatacacttctagtagtttatggtttcagttgttacatttaggttttcaattcattctgagttgatgttcctacatggtgtgagataaagatttaaatacatacatatataaaatcatgaggtagtgtacactataaatatacaattgttaattgttactcaagtctaagtagaggtggaaataataaactttcttttttttacttaaaccactctgtgtcactgagctgatttcacctttagcctgataaaatcattgtcctctccaccctgattcctacaggagactactcaccccataacctcaaaaacctcttcatgaggatggtaagtcacctgaatcctgaagtgaattactcgctattccattggaactcatataggacaccagaatctagacctccagagaacagcaggacccatcttcagaaaataagaagcatttgttccctgagcctgttgaatcaaagtgcaatttctattctttttggaatgttaaaaagtgaatcataatatttaagcaggtgaacccacgagtaacatagcagggtctttcttgtcattattagctccaacctagcacagacattaaaggtacagatgtatactagcatgaaactgggagaacaggagcattcgagcaaccttgagaccaatgggcctctcttataaaatgcacacctcctctcactgagattgaggaaggtttcttgtctccgagccttctcccagtagagctataaatccaggctggctcctccctccccacacagctgctcctgctctccctcctccaggtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggtgagagaggcaggcatgcagagctgctaagtctagagggaaggacgggagagaggttccagagttgggtctcagcagtctatgtcactgaggtggcttcacttagaatctctgggcattgattttctcatctagaaattgaacagagagccaaataaacctgagaaactttatttctccaaagacttgattccaagaaacatctgtgaaattcactaagtttaagatatgaagagacagactagttatttctggatctaaacaagtagacttagttgtaaagagaacattttactctatctacagaagagcttttaaaaactgcagccaagcctgagggtaagttcaggtgtgtgtgtgatggggcaggaatgcaaaaatgagagcaaaggagaatgagtctcaaattctgtgtgacaagcactgctctgcgtgtttattcctatcgactgaggttgttcgtgctaccggctgcaatgcagccagcatcacctgtcagctagcatgtgacttccccgagattctttttcttacccactgctaactccatactcaatttctcatgctctccctgtcccaggctcaaggaaaaacatggactgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatctcaaataaatgccttgttacaagatttctgtgtttccacctctttaatgtgtgatatgtgtctgtgtcaagacacttgggatacacgtaccaaaacgcaaaatcaaatttttgaacaatatacctaccttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggactgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttgatcaaaatttttacctattatgcatttgatatataaataagtatataaatgcacacacagacacagcaatgatggtgaacagtcttcatacaattatatggatgaatctcataaaatgctgagttaaagaaatcagaccaaagaacatatactgaaagattctctctatatacaaagttcaaaaataggtggaccaattcatggtggtgttagaaatcagaagagaggctacctttgtggggaggggacagtttaatgcccagaagcggtaaataaggaatcctctggggagtggtaatgatctggatgctggctacaggatgtgttggttgtaaaaatgcatttttttatatctagctttttccatgtgtatattatacttcaaagaagttcagttaataatttctcatgtcactgtagagtagctcagttagccccagcaagcctctggcttaatcttgttttaccttaagccatcagtcatttacaagtaggaaaattcacagggaaagttagagtataaaatccagaatgaaggtttactgggtaagagtctctccattttccaaagcccgtttatttcttgattccagttcttaagaagtctcagcattgtgtctttttcatgtatcttacaagaagacagcatgtgcttctaacacctgatacattgtatctaccagcacttggtaaacagaaaagaaccacatttttcttgtaggagaaatttggtgcctatttcctaccaggcaccaataagtgggaccaataggtgggattaaagatacagtagaaagtatttaaaacttgccagggggcaatagtctgaaaataagtaaattggtgctatagaatggaagttacaggcttctttcttttttcccacaagatctgctccttgagcccctagagacttttctgtctgttactgtttcttcattcctcatctgcagagccagccctgagaagtgcagaccaaagccagggaaggctctgcaaagatgtacaaatggaagtcaccttaataacctctgactgctgcgcataatacatttcactcaaaagaggggttaaacaatggaacagaatacagaggccagaaataatgctgaacactgacaaccatctgatctttgacaaaatccacaaaaacaagcaatggagaaaggactccctattccataatggtgctgggataactgtctagctatatacagaagattgaacctgggccccttccttacatcatatacaaaaaataactcaagatggagtaaagacttaaatctaaaaccaaacactataaaaaccctggaagatagcctgggaaataccattctggacataggacctggcaaagacttcatgacaagacaccaaaagcaatagcaacaaaaaccaaattgactaatgaaactaatgaaactctttagttgtacaacagatagtttatctgtacaacaaaataaactatcaacagagtaaacaacctacagaatggaaaaattttttgcaaactatgcatctgacaaaggtctaatatccagaatctataaggaatttaaacaaatttacaagcaaaaaaatgacctcattaaaaagtgggcaaaggacatgaacagatgcttttcaaaataagacattcacacatccaacaaccatatgaaaagatgtttaacatcactaatcattagaggaatacaaatcaaaagcataataagataccatctaataccagtaggaatgactactattaaaaagtcagacaataacagatgctggtgaaggttgtggagaaaagggaatgtttatgcactgctagtgggaatgtaaactagttcagccattgtggaagagagtgtggtgattcctcaaagaatgtaaaaccgaactgcctttcaatccagcaatcccattattggatatacaccaaaaggaatagaaattgttttaccgtaaaggcgcatgcatgcatatgttcattacagcactatttacgatagcaaagacatggaatcgtctaaatgcccatcagtggtagactagctaaaaaaaaaaaaatgtggtacatatacatcacagaatagtatgcagccataaaaatgaacaagatcatcatgtcctttgcagcaacatggatgtagttggaggccattatcctaagcaaattaatgcaggaacagaaagccaaataccacatgttctcatttataagtgacagctaaatattgagtacacatggacacaaagaagggaacaatagacatgggacctacttgagaatagagggtgggaggagggtgaggatcaaaaagtacccataggacactgtgcttattacctgggtgatgaaataatttgcacaccaaacccctgtgacacacaatttacctatatagaaaacctgtgcatgtacccctgaacctaaaagttaatggtgggggggtggggttaagctactttgtggtataaatctgagcattcatattaaaataaaatatttacctcattagagtaattaacatttattaagcaaagagccaagtaccttacacacatgatgtttaatctcacaatgatctttaatctcataacaaccgtccattgtatgtacatatgtggaaattgagccttggagagattaaatgcatggggcatgccatttgactagaaactggaagcatcaggatttaaactcagttctgaatggttttgtaggctttgttttttccacattatagcatggcctgccatgaagaacaggtcctttctggtgtttgtcttgtttggtttaagtgaagcaaatatttatttaaatattcaagatatgctgttaaatttttactcaaaaatttgagtacagtatggatcttctgaagccaaataactcttattcaatgcttagttgagaaattttatggagtagttctcaatttttatgtagttccactgcaaaggtaagtcttatggaaagattcactgtaattttttttcctcatttggacatcagctttttcttttcctcagacccgctgaaagataatttttaaaataaaaaccttgtttttatatcaagtggggacattttttccaaatgaaaaccgtgtattcattttatatgataaaatcaatgttattatttttaaaattttgatttaaaaatcattaaaaataaattttcagatattacctgaaattctaccatccagagataatagtgcttaaagatttgatatatagacacacacacatatatacatatatatcatcctaaacttctttgtataaatgtatataaagtttttaataaaaactaggagattaatgccctttgaatgaaaataaatacaatgtgtatgctttaacatcttgcctttactttataacatttatcacagcagtcatgagataatgatttacatggtcattgttagtaagctaatagctaagtgcatgaactctggagctagcctccctggattttaatcccagatctgtcactgaccagctgagcaatactaggtaaattgctcttgttccttagtttcttcatctgtaaaatagagataaaaataatatccacctcataggattggtgtgagcattaaatgagcatacgtatgtaggccacttaacaacaatgccttcacatactgaacacaaatatacgagctgttgtcttattgggctcatgtttttcctaccactaagccgcatgcatgcaaggaccatgttggttttgttccacattgcatccccaacctggtatacagtgtgcattcaatagttgttgactattattactagtggcatttaacaaatatctgttaaatgagtgaagaaatacccatttactgcaagtgtgtctaatattgatggcataatgggggaaactcaaactctggagtcaaacaggttttaaaaccttattccctcatcctcagttattgacgttttttttttggcaggtgtgtgtgtgggacaacttattgaacttttctgaatttccagcttcgcatatataaaatagagatagtgattcattcttgcaatgtatggatttgagacaattgtgtaagtttatcaataaatagtagctatttttgtataagtattacatataatatccaggccactgctttgcataacccaaaaggggcaccattcatgcagaatacaacataaatggtgtccctggagcagtgcagtataggaaccctgaggggacctacagtatactttatagttcatagattacaaattatccctttatcagagtctctcaaggttggatgtatttgaggtccataagagcaatttaggattaacagtagctgcagaaaccatctgcagtgatattctcattttaaatccgcgggaaagaagacagctataaacttgggacctgggtttaagcattttaaatgccaagttcaccattttctaaaacacaacaaatacccagtgagagagggagaagggaagtaaatgcctctgaataagcaagttaatgtcagtagttgtactgtatgcatattgatgaacaatagaggaaccaatgtccaatcagatgagcaggatatttggcaataacaagttgcctttgaggaaaaatgattttcttggcaagttctttatcagcattacaaagctaaaagctacgcttatcatcacttatactagcataccctgttgtgcaaatgctgtctgtgtttgcatctgctattgttgatgcctggtgcatgaatcaggactccagcccacaagttttcccagaactttcttatggccatcatctttaagtgtctggtgaacagtcatagtttggtacacaaaagggtcaacctgggggatggctagggtttgactcagtcgttacatttcaatagagcaggaaggggaaatggtggcctgtaacctcagggaattttgccagttggtccaccccactctctctctcctgctctgaggaagtggcacagcctagaacagcaccacaggtgagagaaatgcaaaccctaaccagagaagcagactctttgccagtagtaatagttcaggaccaccaccagcttttattaaaatttttaataacactcaagtattggcagaaagaaataatcttgggttaactataactagaatattgactcttcctctgtggaagaatcagccaatcacatttgtttacatcagttcccctgaagaagaaaaatacactgatgttgcagcaagacaaatttaagctagatgtaaataacttcctttagcctgtaatgctaggctaattacatattggaactattttttcagggaagaattgtgtagggtttcagggaagaattctgaagaaaatatagagctgaaatgatcttgcagctcactgaaactgcagggtttagatccacactgatactcgttctattatcactgtaatgaaggctgatggaataagtaaaaatgttttgtattagtatgtttttacacttatttgcaaggcataaataggttaggttttgatcttaatttaattctaacatgtattgtgcacaagctgtgagcagttttcaggagttaggtatctggccatgactgatttttcaggagttaatcatctggtagaagggtcatacacaataggaagatgtgtgtgacaggttgtgatcattactataatcacacagagagctgtagaattttaggctggcagggtggctcacgcctgtaatcccagcactttgggaggccaaggcaggcggatcaagaggtcaggagatggagaccatcctggctaacacggtgaaaccccgtctgtactaaaaatacaaaaaaaaaaaaaagccaggcgtggtggtgggcgcctgtagtcccagctacttgggaggctgaggcaggagaatggcgtgaacccgggaggtggagcttgcagtgagccgagatcgcatcactgcaatccaacctgggcgacagagggagactcagtctcaaaaaaaaaaaaaaaaaaaagtcatgttagatccagaggggtagcaactggggctgggctgtcagtcaactcagtcaactcagtcaactctgctcccccacaggagatgccagtgatgcattttcatggccaacattgtcagtcagcatcattgaattactcctgattatagagacacagctgcaaacgattccccattaaatatgatgtttcttgcaatgtttggaaggtactcctttttagtaagggaaatcccctcttctggcttgctgaaagttttttctttccattttaaaaatcgtgaattcctttttgcaatattgaggtggttatatggtttctcttctctaatctgttaatatggtgatttaatggttagaaattttctaatgtaaattccactcatattgcagaaataaacctaaactgagcatgaggctatattttttatttgcttctatatttggttgctatacagtattatgtttaagatttgttcacatatatttgtgaatgggattggactatttttccttcttgccgatttttatctggtttttaaattaaggatattttagacttatgaaatatttggcaaacaatccttggcaagtaattttttggggaatttgttttggctattttgagtattacccaatatattttaattaagttattcttaatgttttcttaattaaaaaaattacctactctagagatattctttatgtactccagattttgtctatttataccacttttcttttttcctcgatgagtgtcatagatgttcatctatttttttatcttctttgatcttctcttattccttgtttctattaacttctgaagtttattattttcttttttccacttccttatggtttattctttcaatttttctctaacttcttaagttgggtgtttaatttttagcttgctttgcttttttaggataagcattaaaactacaaattttccttgttattcttttgctgcaccccaaattgttgatatttctattgtctaatttctattcaattagaatactttaaagtttctttttggtttttaaaaactaactttttaaattgacaaataaaaattgtgtatatttattgtgcacagcatatggctttgaaatatatgtacattgtggaatggctaaatttagcttattaatgtatgcattatctcacatacttatcattttttgtggtgagagctatgtgacttttgaacttatgagttatttaaatatttttaaattattaagcatattgggattttaagtaatttacctttttattattaacttataacaagtagaacagttaacctgtatgattctacatcattgaaatttattgacatttgcttcatagtctattatatggtctacttttgttcatgttacatctgtagtagaattggctaatagttgagtaaagtacacatatgtctatgaaatcaagtgtaatccagagaaaaagagaaatttactgaatatattgttctaggtgctattatatgttgtcatgtttaatcctcaccacaattgtatgaggcagccataattaattccactttacacatgaggagcctgagggttaaaaaaaaagctagctctactatttgtaaagaatgaagcaaagatacaaatgaaggcccacatatcctataactagatatttaagcattttaattcaagctttaaaactgctaaataaaatgtgctccaatttctatattgacagacataccttcctaatgagctggggttcgaatttagaaatctttgatgcttcagagtccacactgaaatgtggaggcacatagtgagttggtccccagccttcagtccacccaccttctctttactaaatcacctttcacatacatgtatgaacaccccagcctccaagtccaaaccctaaacaaaatgggacacccttgtgcatacacagagacacagcccatcctcaggaaaacctggaaaagtccatacaagttctggaagcaagcttgggacggtttcagtagtgtggtctataagggaggcctcagaagacaggttttcttaattctgtgaacttctcccacagtagaaagggtgctggaggagggtcagagtgaggacttctaaagcatgggtcctgagtaggggccactcttgcccaagtctaagaagggtactagaatagcacactactactagatactagaacccagatacaagcacaggtcttctgaaattaataataataataactattaccattattataccagtagctgtcatttatttagtgcttattatttgccagtcactgttctaaattctttacatgtattatacaactgccatataactgccatatgagggatgtaccctcattgtcaccattttaccgatgagaaaactggcataaaacgtttaagtaacttgtccaagttacagagcttagtgaagccacaatgttgctcaatttgctctcaaacttcaaagggatgggaaggacacctaagtcatagagtctttaagaatcagagctagaaggaatcttagatgttatctagtcagcctcctcccattacagtccaagagaagatggccctgagttacttgtagctatttttgcatgtgaattgcaagtgaatatacattctactgaagataaaagatatttaaagatatcgctggatataggaacagtggttttaaatctctaggctttaacttttctcagaacaagaaatcctttttggttttaatctatatgcacatctgtatttttctcaattatcgggtagtaaaatataacttttcttctgtaatattttttaactttaatgagtgttcctcataatagaaaagtttggaaaccattgctatgggtatatactttctaaagggatagtaatttctctagaatattcatttaatgctccagaagtaattagcacaattgtgcaagtctgtgcatcatcaactatacattctgcctgtttactccaaatccacatgaaactgattatacagtcaaaggcgagcccagtggagaggcatttttggagacttcctggtacattgagacagggtcggccagtctgcgttagggtcttggtcaaaactgcatttctgaaactaaactcagattgctttcttttaaggggtcagaactgattcaaatctacatttttaaaagccttagatgtggggcttttcctattcccagtctccgctattggtctttgtgaatccacaggcaatttggccacatccttgactctctcttatattaagaattaaacagctaagttcatgcagaggaaatataacaaaggagggactttcctacaagatctttgaaaaatggaacatttgcataagtcatatttagccagaactgttgttttatattttcctttctgaatactttgttacacctcctcccagccaaccccccccctccctgaccccaactagtcagagaccaaagccttcacaatggtttacacttgaaccttcctggccccaccctcatcatcacgcctgaataattacattcactgactggtctcccctgcttccgtttatctccactcctaaaccctctgacaccttaatcttcccagaataccattgtgatcctgttccactcttgctcaagttttcccagaaactagagtacaaactttataagctttagagttgaaagccactctatctctttttcatccccaggtctctgccaaggcagtataacctgtccaacatctctaacttcaatacctttgtcttagatactagactctcctcctggtttctaattaaacctgatctaggatctaattttgcctctgaattctgttgccctttgccaagtgatctcttcctcctctgagccgcagcatctctgagcttgcacacttagcatagccatagcacacacagccttagcttgcagttcagggtgtttaccttccctccccttccagatgctggatccccagggataggaactctgcccttatgtgtccatagcccctggtagtatgtcttgcagtcgtacattttcagcaaatgtttaattggttaattgaagacaactgtcccatgccttaagcctctctttttgctaaacatgcctgtgtcctttgtcattgaacaactattttgatctattttcttcctgacataggggtcagttccgaggatgctgaaatcaagagacatagcttattctctcaaaattgctttcaagagtgattttgttgtgaattgagaactggctgcctacttttggactacccacttcagcaagagtgtttgaaaccaaatctattctaagtaattttttattcccttttctctatggcattagacacacagctcttttaaactacctttcgttatctattaaacagacattcagtaactctatagacactgtctagctatatgaacttagacaaactaatatctctgagcttcagtttcttaaaatttaaaatgaggacaataccatctatggccggggattaaatgctatgaggaatgtaaaccagatgtcaggtaccatctctctaaaatccagataaaatgaattaaaaatactggccgcaaaccctctctaagagttctcaaaattctcagagagcttaattttcatgctcaccatagcaccgattttcttctaaatattttgtttctaccaaaatattttgtcccaattttgccttttatggctatttcttcatatccactttcccaaactaaagaagcagccccttcaccttaaactcctccttcaaagcaacctaaatacaggtctgggtttgtattcctagtgggatgttacagaggttagtgtgatgcagaggaggagtcatgctgtttaaatccatactagtccccagaggccaggctgcttctgccacccctacccctcccgccacagagctcttcagcttctcacatttctagttcttctctctctactttcattaccttctctctttttttttttcttctcatgtgctcacgggagcagagaaaattaactcctctaagttttcttaacacagagtgccttaattacatattactattgtttgagttcctgccaacactacgtctgtagggtcacacctgctatattagaggcttatcaaaaaaagatagctttctcctaaaaagggatttggatgcctactaagataactggatgccaagataagtttaacctaacaaactttattattattattattattattattagagataggtacttattctgtcacccagactgcagtgcagggatgcaataatagctcactgcagcctcaaagtcctgagttcatgcaatccttctgcttcagctccctgagtagctaggactacaggcatatgctactctgcccagctacttttaaaaaaataattagggatggggtcttgttgtattgcccaggctcgtctcaaacttctggtttcaagcaatcctcctgccttttacctccctaattgttggagttacaggcatgagccacagcactcaaccaagatttaaaaacttttaaaagaaatcacattacttactgttatcatcattatggttactaccagtgttaaaacaattggtattgaaaacaccactaccagatcaagcttcaaaccaagatgtcaagtaaatattattgtcagacctctgagcccaagcctgcaggtatacacccagatggcctgaagcaagtgaagaatcacaaaagaactgaaaatggccggttcctgccttaactgatgacattccaccattgtgatttgttcctgccccaccttgactgagggattaaccttgtgaaattccttcccctggctcagaagctccccgactgagtaccttgtgacccccacccctgcccacaagtgaaaaaccccctttgactgtaattttccactacccacccaaatcctataaaacagcctcacccctatctcccttcgctgactctcttttcagactcaacctgcctgcacctaggtgattcaaaagctttattgctcacacaaagcctgtttggtggtctcttcacacagaccatgtgacatttggtgccgtaactcagatcggggaacctcccttgggagatcagtcccctgtcatcctgctctttgctccatgagaaagatccacctatgacctctggtcctcagaccaaccagcccaaggaacatctcaccaattttaaattgggtaagtggcctctttttactctcttctccagcctctctcactatccctcaacatctttctcctttcaatcttggcaccacgcttcaatctctcccttcccttaatttcagttcctttctttttctggtagagacagaggaaacgtgttctatctgtgaacccaaaactccagcactggtcatggacttggaaagacagtcttcccttgatgtttaatcactgcagggatgcctgcctgattattcacccacatttcagagctgtctgatcactgcagggacgcctgcctggatccttcaccttagtggcaagtaccactttgcctgggtggcaagcaccacctctcctggggggcaagcaccacctctcctggggggcaagtaccccccaaccccttctctccatgtctccaccctctcttctctgggcttgcctccttcactatgggccaccttccaccctccattcctcccttttctcccttagcctgtgttctcaagaacttaaaacctcttcaactcacgtctgacctaaaacctaaatgccttactttcttctgcaataccgcttgaccccaatacaaactcaacaatggttccaaatagcctgaaaacggcactttcaatttctccatcccacaagatctaaataattcttgtcgtaaaatggacaaatggtctgaggtgcctgacatctgggcattcttttacacgtcggtccctccctagtctctgttcccaatgcaactcatcccaaatcctccttctttccctcctgcctgtcccctcagtcccaaccccaagtgtcgctgagtctttccaatcttccttttctactgacccatctgacctctcccctcttccccagactgctcctcctcaggtcgctccccgccaggctgaatcaggctccaattcttcctcagcgtccgctcctccaccctataatccttctatcacctcccctcctcacacctggtccagcttacagtttcattctgtgactagccctcccccacctgcccaacaatttcctcttaaagaggtggctggagctaaaggcatagtcaaggttaatgctcctttttctttatccaacctctcccatctcagttagtatttaggctttttttcatcaaatatgaatacctagcccactccatggctcatttggcagcaactcctagacattttacagccttggacccagaggggccagaaggtcatcttattctcaatatgcattttattacccaatccactcccaacattagaaaaagctccaaaagttagactccggccctcaaaccccacaacaggacttaattaaccttgccttcaaagcgtacaataatagagtagaggcagccaagtagcaacatatttctgagttgcaattccttgcctccactgtgagagaaaccccagccacatctccagtacacaagaacttcaaaatgcctaagccacagtggtcaagcattcctacaggacctcctccatcaggatcttgcttcaagtgccagaaatctggccactgggccaaggaatgccctcagcctgggattcctcctaagccatgttccatctgtgtgggaccccactggaaatcggactgtccaacttgcccagcacccactcccagagcccctggaactctggcccaaggctctctgactgactccttcccagatcttcttggcttagtggctgaagactgatgctgcctgatcgcctcagaagcctcctggaccatcacagatgcttttggtaactcttacagtggagggtaagtccgtccccttcttaatcaatgcagaggctacccactccacattaccttctcttcaaggtcctgtttcccttgtcttcataaatgttgtgggtattgatggccaggcttctaaaccccttaaaactccccaactctggtgccgatttaaacaacattcttttatacacttctttttagttatccccacctgcccagttcccttattaggctgagacattttaaccaaattatttgcttccctgactattcctggactacagccacatctcattgctgcccttcttcccaacccaaaagtggcaactcctttgccacttcctctcatatccccctaccttaacccacaggtatgggacacctctactccctccctggcaacaaatcacaccctcattactatcccattaaaacctaatcacccttacctgggtcaacgccagtatcccatcccacaacaggctttaaagggattaaagcctgttatcacttgcctgttacaacatgtccttttaaagcctgtaaactctccttacaattcccccattttacctgtccaaaaactggacatgccttacaggttagttcaggatctgtgccttatcaaccaaattgtcttgcctatccacgccatggtgccaaacccatatactctcctatcctcaatacctccctccaaaacccctccataacccttattctgttctggatctcaaaacatgctttctttactattcatttgcacccttcatcccagcctctcttcactttcacttggactgaccctgacacccatcagcctcagcaacttacctgggctgtactgccgcaaggcttcatggacagcccccattacctcagtcaacccaaatttcttcttcatccattacctatccaggcatagttcttcatgaaaacacacgtgctctccctgctgatcatgtccagctaatctccccaaccccaggactggcaaattgactttactcacatgccccaaatcaggacactaaagtacctcttggtctgggtagacactttcactggataggtagatgcctttcccacagggcctaagaaggccaccgtggtcatttcttcccttctgtcagacataattccttggtttggccttcccacctctatacagtctgataatggacaagcctttactagtcaaagcacgcaagcagtttctcaggctcttggtattcagtgaaaccttcataccccttaccgtcctcaatccttaggaaaggtagaactgattaatggtcttttaaaaacacacctcaccaagctcagcctccaacttaaaaaggactggacagtacttttaccacttgccattctcagaattcgggcctgtcctcgaaatgctacaaggtacagcccatttaagattctgtatggacgctcctttttattaggccccagtctcattccagacaccagcccaacttgaactgtgccccaaaaacttgtcatccctacaatcttctgtctagtcatactcctattcaccattctcaactacttgtaaatgccctgcccttttttacagtgctgatttatacttttcctccaaaccatcataactgatatctcctggttttacctcaaaccgccacccttaagtctctcttaaagtggatagaagatcttcagtgacaaggtacactccaatactttcaccctaataaagccctattctttacttttatattcactcttattcttgttcccattcttatgccactctctacctctccccagctatctccaccacactatcaatctcactcactctctcctagccatttctaatccttctttaacaaacaattgctggctttacaatttctctttcctccaaaatcaccgagtcctcaatttactcactgctaaaaaaggggactctgcatatttttaaatgaagagtgttgtttttacctaaatcaatctggcctggtatatgacaacataaaaaaaactcaaggatagagccaaaaaccttgccaaccaagcaagtaattatgctgaacccccttgggcactctaattagatgtcctgggttctcccgattcttaatcctttaatacctgtttttctccttctcttatgcagaccttgtgtcttccatttagtttctcaattcatacaaaaccgtatccaggccatcaccaatcattctatacgacaaatgttttaagggaggagaccacccctcatattgtcttatgcccaatttctgcctccaaagaaagaagtaaaaatgaaaaggcagaaatgaaatccacaggcagacagcctgatgccacaccctgggcctggtggttaagatcaacccctgacctaatcagttatgttatctatagattacagacattgtatggaaaagcactgtgaaaatccctgtcttgttctgttcctctaattaccagtacacgcagcccctagtcatgtaccccctgcttgctccccctgcttgctcaatcagtcatgaccctctcacgcagacccccttagagttgtaagcccttaagaggaaaaggaattgttcactcggagagctcggtttttgagacatgagtcttgccaatgctcccagctgaataaagcccttccttctttaactcagtgtctgaggggttttgtctgtgtcttgtcctgctacagtttcatctaacaaccccataatatcaccccttaccacaaaatcttccttcagcttaatctctcccactctaggttctcacgccacccctaatcctgctcgaagcagccctgagaaacatcgcccgttatctctccacaccacccccaaaaattttcactgccccaacactttaccactatttcgttttatttttcttattaatataagaagatagaaatgtcaggcctctgagcccaagcctgcacgtatacatccacatggcctgaagcaagtgaagaatcacaaaagaagtgaaaatggctggttcctgccttaactgatgatattccaccattgtgatttgttcctgcgccaccttgactgagggattaaccttgtgaaattccttcccctggctcagaagctcccccactgagcaccttgtgacccccacccctacccacaagtgaaaaaccccctttgactgtaattttccactacccacccaaatcctataaaacagccccaccccatctccctttgctgactctatttttggactcagcccacctgcacccaggtgattcaaaagcttcattgctcacacaaagcctgtttggtggtctcttcacaccgacacgcgtgataattattatattacttttaactaaaaccctttcagagtctcgcagggaaggctgtatatatctcataaaatgttggggcccactggatcagacaaggccacaaaggccaaagggaagtaaagatctcattatttctcctaataatttccctgtcctttgtcataaatggtgggtaggctgttatggtgatggcagattttctttccataaaatgtccataataggacatttgaacagaagggaaaaatcaaattgctgaagttgaaagagggcaatgcaaagaactttggagaaagaactgtacagagaagtcaactggcagatgggaggaagtttaaggggaaaaatatagatgtctaaagaatacatttattcattttccacagtgcaatttggacaagaagcctctttcttgcttctttctattctcattaaatcattagagctcaagcaatccttctgcctcagcttcccgactagctaggactacaggtatgtgctactatgcccagctaattttttaaaaattagattttaatttggtgaactatttctgtaggaaactacaataatacagcccaggcacattgatcttgggtgaacaaatcagaaggaatgaataattctgtgttcctgggactctgacaatttcatgaacttggtactctgagtaaagcataggaggagttatttcataaaatgtggagcacaatcatgtgacaaagataatgggatccccatttcataaataaatctgaagttcagagagagtaacaactggccagggtcacatcacggagacagaggcagggttcccactgatgcctctgactccctgtcccaggcccttcctcctcccgcaagcagaagtgcagggggcagagctgaccctgtgcagtgaaaatctgagggctgagttcctattggaacacaagtgaaagacttcctggcttctaatctcaggataaggactcagagctccatctgttccagccttaggataagaaccagaatcttacaccatgaaagcatgaaaggtaagatttgagtgaggaaaaaaaaaaaaaaagtctgtgtttcagattcagttcacaaagcagtttcatacttaaggtaccatcacaataaccctgtggggtaagcaaggcaaatttcattcttgttttatgggcataggaagtaagtctcagggaggttaagaccaaggtttctggagaattttatattatgaatcttgatttatgggattactattatgtaattcctaagatcatataggaatcctagagcttgaatatagaactttatttttaaatctatatacatcataattacaaggagtagtgtccatttgggttccttggccctgatgtgttagtggaataaacatttttgtcagggttgccatgtgtgtctgtgcacgtgtgcactgtacacctccaggggatgtaccctaaaccacatgaatgtgatttgcacatccaagatttacagtgtactatagggagaatcttttgcaacagcttttgctataatacagaatctgagatgtctttgagaaagaaaagtgtaatcattaccaaaaaattattctcataatgtgtgcaaatttgtatgaaatctatattggccatgggacaaggaggtatttccagctagcttctgaaagggctctattctctcataagaattcagctgttgacattaggtgatatctgcccaggtcatcagatgccatagagaaagagggtttgctgaaacttatatcagcagtgcactgtatgctctttctgatttatttgaacattcatttattgagtgtcaagtaatgcactagatactccagggatctgacacaaactctgccctgaaggagcatgtaatctcactggggagaaaacaaaacatatgataatttcaaaataacaaactaggcaaactagttaacacttaaaaagcaggctttattcaaatgcaaaattgcatgttacagggtaacctttcagtaagaagccaggaagaggagctcatcatgggttggattagtaaaggactagttataaaagaagtggtggggttgagggaggcctgagatgaaatttaaagaatatgtagaatctaggtaagtggataaaaggtctgggggcaggggaaaggagagcatttcattgtgaatcaaggaatttctccacctgttttaactcttccatatgacatcaaagagatgtcacttgcagctagcatttcagtgatgttttcttactaataatatcgtgataaaagaaacattgactataagaaataggaatgggtctcataaaaggaaacagcaaaacccccaaactaaaaaacagcgcaggctatttctctcttctctccttttgcttggcactcatgagatgctaggtgtggaagtcagccaactgaaaaagagaggtggctgaagaaggtggggaggctgaagccagttaaataggatggtccaattcacagacggcgaggctacagtgcaaataggactctttcaacttgagcaggaccccattacttcactggagttagaaagaaaggagagcgtagactttttgaactttctataagagtgtacctccacagtatacagaagacgacgtgaaatttgatctgcaagaaaactgagtccatattcacatatgtatcaaatttgcacttcatttagaagtgtctgtcatcaagtacagcactgaattgaaactgaaaacaagagtcaagaaagagcaaagtcagccatctttatattccacatgaatcctttccctttatggtcttatttgtttctcctcagaaaagacaaaaagctgagctgtataaacacctgtgggctgggggttgagggataaatgaggggcgaaatggaagctgaaggaactgttggtcaggtagaaatcttcccagatgcactgaaggaaacacacttcatgtttgacgtaggaggtgccaccacacaaaacgtttcatggaaggatttaaaggatctcatgatttttagtattccaagaattttctttcaccaagggcgatttaatatgggtcattcatactgaaagaaaaacaaaagataataagagtttaaaaattgcaaaacttggagtgttagtagtaaaggtaaatattcattagagatgagaagaggagcaaggaaatgctttcagctggaaatctcagacaagaggccaggctttaggaacctctgaagatgaacaaatgtaagcaaaccctagtagcagcacttctcagattttcatgtgcttaccactcagagatggtgttaaaatgcagactctgattcagtaggtctgagtggagcctgagattctgcacccctaacaagctctttagtgatgcttatgccactggcgcacagaccccacttggagaaatttttgtggtgcatacggtctttgtctccagatctaatgagtctgaaggacagtgtagattgattttttaaatttatgtttattttaatttaatttaatttaatttatttatttatttatttttgagatggagtctcactctgttgcccagtccggagtgcagtggcacggaggcagctcatgcaaccacggcctcctgggttcaagcgattcttccgcctcaacttcctgagtagctgggaatacaggcacgtgccagcacacccagctaatttttgtatttttagtagagatggggtttcaccacattggccaagctaatctcaaactcctgacctcatgatccacctgccacggcctccgaaagtgctgggattacaggcgtgagccaccgagcccagctgtagattgattttgagcagtggaaagtcaaggaattagaaggcatgcttaaatggaaagtgaaattggagaaaatttaaactcatgaaatagtggtggttataaactcgtgataaattatatcctgggatataatttaatgagatggtaacacatttagtttaaagaaataagtgacactttttttgtgtgacacaactgtcttattcttggaaaggacaaggagagaatgaaatatggtatgtcttcacagcacctttcaaagggagaaccagattctgaggagctggtctcatgatgaactgtcagggtaaaccacagttcagcagctgcaaatgtgcttgccaaaatagagacaaaaaaatgtttctgaaaacaaaatttcacatatgccctcctctgaggttggcatcatatcttcctgtgtatcttgggtgtagcttctatcctgccagaatttagacagtagaaaccaaatgaggtgataaacagagtcattttgcagaagagtcaaaataacccagcaagaaatgaaaccacaaatgcccaaggagtcattcattcaccattcaaaagctaatagaaatgaacacaaactactatgaaaattcacccaagaacttaaaaaaaaaaaaaaaggctcatggtgtttagtgtgatagtattcattttacctttgacttgttctaaaaacacaccatacttctaccccacccttcctcagtgccgtcacacaatggtttcagtgtgaaaaaaaaaaccacgttactggaaaaggagggtgcctgggacttgccactctaagctggtagtcaagggtcttgagttctaaaagcatacgcgttaagagcatgattcctggatccaaatgagtatggatctcagcattgccatttattgtgacctcaggctattttatttctctgtgcctgtttctttatcagtaatgaagatgttcatagacccttctcccacagacttaaaggcatatttcatgatttaagacatgtaaaccattcataacagtatacaacatggaattaatatttgataaaggtttatgattattgtaactaactctgtcacttgctcaaggcctatagaaaacttacttaattagttcaactacaaaaagagtttgaatgtgatatccaccaagatcatattcagacctagaattctgtgattcttatgaattaatacagccttggtcaataaatgagagctgggcaaataattcttctttgctaggcctttctagaccatctggtgaagcattcaagacttatgttattggggccagccttcctttccaacttcaactccacaactcctcaataagccatgggctcaagaaagttctgctcagtggcccctgaaaaatgctttcatagtctcactaccataccactgcttacacaatttccttcctacagactgccttcctttcctgcttttctccatatacctaaatcctatctattcttcataagcaaccttctttataacattttctataaccaccaagccaaatgaccttttccttcttaaatatagcacccattggccattaccatgctctgccttgtatttttctgatttttttctttctatattcctgtcttaactccccagctaggtaataattttcctgaaatcagggaccaggctgactcctcttgctgtctcaagaaagcttagcagtttccaacacaaaaatgttcaataaacaactattaattgactgattataaaaaatcagtgaaccattaaacttaatatagcaatttgcttagcatggtaattagctttttgctaatattcttccagccagtctctcctcctgtgcctcaaggacatcttaaaaaaaaaaaatctagttgatctgcttccatctagtggcaattaaaacaggtggttccggtagccagaaaacagctctgggtagattgtgccagaaaatactttcactcagtaggtgcgagtttgaaagaaatcttcacatctgtgggtttcctgccacagacatagggagaccagcccagagaaagaagcctttcctcactagactccatttgcactagtaaagagaagacagagtaattaaaaagaataaaaagaacctccactgatcgtacatcctcatccagttacccctgccccacttctccttcacagccaaacattttaaaagagatgactgcttgttctgtctctactttctcatcctcagtaatgctcaatgcttggccgtctgacctctgtcttgatgtctgcactgcaaatagtctccccactgacacccttgttgcatccaggggatacttactggttctcttggcaatgtttgaaaccgttcccctttctttgtttccttggcattcattaccccacactctttctcctcttccttctccctgcctggcaacatcttttcatttctctttcccttaggtgacttattagataatgatgttcctctggctcccatactctctcccaggtcctcttccattcttaaagcactcacaccctccctggatgatagtacccactcctgagatggcagttacctcctgaaatgtgagggacccaaatccacttctcctgccatagcctctgtgctttggataggtccaatgagccacagtgaatgatgtgcatacacccaaagctcagtacaaaactgaacccatgatctttacctccaaaacctctcattcttttatgttcccttctcagaagtaaacaggactaccatccgccagtttccaggtgagaaagatgataatttgattcttctctctcacttttagccaattaacagacacattcagttaatatcacctcctcttatttcatgaacccattcttactactagttccctagacaggcgccatcggttttaatctaataactgcaaatgcctccaaaacaagtctctttgaatccaggctcacctgtctcccacacttgccatactgctctgcagggtgaccttataagatgccagaggtaaggctactcactgtttaaacccctttagtgatatcccaaaagacctcaagataaagcccatatcacatggcttatacattagtttatgatctggcttctggtgcctcatttttccccactttttcctttgcattctaagcaatggcccatactaagtttgtgattggtaggatggttgcccaaaccagcatccaatcccttcagaaatcatctcacttcatttctagcattttaaaggaagctcagttgtccagctgggtactgaatatgtcaccaaagtcctcctttcatagtttattttacttaaactctccttcctaaaattccagagcaagtcactaaaccctagatactgagaaatatttttccatcttcatttctgccaggtgggccatcaactttcacatgtctgcatctcctcccactgtgctatttctccagtagaagaaatttgagcttcaagaccaaactgaaaaatacttgcctccttggggaagctgtaggtagaattcatgctccctatctttcccacatttctgaaggacaatgcctgttagagcaattgaatgcaaatagtcaattgaataagcatttattcatttctcaataagtgcttgttcaattgaatatttcttaaataatatatttaagaacaagaagaacacaccacaatgtttttaaccctcagaaaaaattctgaggtaatcagaaaaatctccctttacataaactgcccttttctaatagggattacttgttcgttcattcattcattcagctccactagcaccaaaaagcacagctctgaaaggaagctagtagatttatcaccttatctggtcatttggatgaggaccccaggtaaataaactactatggggttaatgtgtctagctagagcaggaagtaacttaaggaagtagagaatgaatcagcagatgtggaaactcctcgccactaataaaacttaccttctcttggatttcttgcctgaaaatagaaaatagagaaaaggcattagcaaaaattagacaatttaaagtttttcaagtaagggagaaggaagactcccactctcaaaactgtcttttgaagtatattaggtatttgttaggtggaccctatctgtgtcaaaggagatttgaggaactggcttaataaacagtggtagacactaatacagaacagacatgttgatgcagatgcctcctgaggttccattccattctccgtgctactcaagaagacagaattgctaaattgcctggtggcaagacccaatatgtccattcaagtgtttatcccttcccaatctgccatctcatcctacctgcagattcttcccttgagggacagctgctaatactgtaaaactatgtgccattacagctcacagcatcatctctatgagaatccacaagagaatttcactttggtcttgttggtaggaattgtgcagcctcatctgagtaactaatgtgtttttatcttacaaacacaaggaatatcacatggttctcctttgactggctgtaaggaaactcagagctagatctgagaccctctcctaccaagtatataaaactttgtgacatacatttttgtgccataacttcaaccttggttccaaatgatttttgtaccctaagtttaaatttggctttcttttttttttttttgtactcaataaaacatcaagctcatttattattgcgaagagcgaaacaacaaagcttccacagcgtggaaggggacccgagtgggttgcccaaattggcttctttttcttactttttaattaattttaatttgctatactgaacacattttgtactgttctcacattctttttgaaaaaagcagaatataaataagtagataacttaaaaaaaactctttgagcagaaagaatcatttgggaggcaatatatttcagtggctgtaaagtggcattctagaatcatcctacccaggtgaaagccctattttgccacctgtagtgtagtgtgtatttgaacagctactttcttttctaaactacaatttcttcatctgttaaagaggcataataattgtatcatcctcattgggttgataaaataaaatatttccaagtatttagttcaggtcctagcacgtagacagtgttgcattactgttttaatcctttaaagtattaaagactactatttgaaatcttttcttctaaaattcagcctgctgatgaccaagtgcacttgagcagggggaatcaaatctgaattaatttcagattctggttagcttcacataaatattttttttagggatgatgaacctaacagcaatagatgagtaagaatctgttcctactgagagagtttcattttgaagaaaaaggaactaagggggcatgtgttcagtttcatgccctggtctaaccctgtgtgttggttctggtgggaaattcttccaaccgaggaaaaaaccagttcacaaatctgaagaccagtgattttagaagatgtatctggactggagtctaatctctgactctgggtcctgctgatatggtatttttgagatttggcctaaaacatcattgccctggtttccttatttaccaaacagggccaatggtagtgactaatcagaaaatgataatgcctggtgcacaaaatgtgtctagatgagcccatgcacaaggacacatgtttctggaactgttccttattcctttcctaaaagaaaggagggaaagtctccatactaagactactagggcaggggacaaagtgctagagtcagaagattcatctgaggacagaagaataggggtgaaggctctagtcacttcattggctaccatgctctaaatagttacctgtgccctttttctaactattagaacccaaaaagcctataaattctctctctctctctctctctctctgtgtatatatatacatatacacacacacatagacacacacacacacctaaacacacacatagagatttatgactttttacttttatccttgtaaatgccattaactatattttgtcttagatttagcctgggaatgtagccattatttctaccattgcctccataggaaaaatactcttcatgttttaaaggaccaacctacaactaaaatctttggaaagcagaatcatttgtaagttggtgaaaatggaagatgttgttttataaatgaagactttttttttttttttttttgagacagggcctcactctgttgtggagtgcagtggtgctgtcatggcttactgcagccttgacctcctgggttcaagtgatcctcccacctcagtctcctgggtagctgggactacatgtgcatgctaccatgcctgactaattttttgtatttttgtagagatgtggtttcgccatgttgcccaggctggtcttgaactcgtgggctcaagtaatcctcctgcctcagcctccaaaagtgctgggattagaggtgacagccaaggtgcctggcccacagatgaagactatttaatgttatcttaaagataccctaagcttcctaccaagccagtgatcttttggggcttctgttttctttgttggcataactgtaactagcctaactgcccgttatctgtttcctgtttgccccacactgattcccacagcagttttcaagttatcggtttgagatcttgtacagaaatgactccaaggtaaaaaatttaaaaacaacccctctaatttttttacccttgcttataaaacagccttagccagctaacccctcactacatgcaaatgagtttgattctattcttttgattctacaaacacttattaaaagattttagaattcggaaataaatagcttccttattaaggtgacttacagccccaaagtccttaaaattatttagacaatagccaccttatcccagggggcagtgtgtaataacccaccctgttctctatccgtcagttctgccatcatcgcccaaggtaggaagaaagacaggacaaccggggtcaagatttgaagtctcaatggaaagaataatcagtggttggagaaaactgtcattcttcttttgccttaatgcagtacttgatacttatacttagtactgtatagtacttagtactgtataatactataagatagtgagattcaatcagcacagaatttctaatagcaagggcagagacattttaactgctcagtgctctcaggttatacatagctaatgaagttcttgcatatcaacaatccccacccccctcacacactttgtctttctggattggttagaaaacttacctagcgcccactattctcaaatttaaatgaaagataagatcagagtggcacgcaattagggactgataaataatatttttgtaattgccagtgtaaatggacagggggcaacctttacataccatattcagtgaacagaatacgtactaactaatttgatggaaggaaaattaaaatgacaatcaactgagcccacagaaaggcaacacagagcagttggttagcaattgtttcgagatcatccctgaacttgaaacaggtatatcttttttttttttttttttgagacagagtctcactctgtcaccaggctggagtgcaatggtgcggtctcagctcactgcaacctccgcctcccgggttcaagtgattcttctgtctcagcctcccgagtagctgggattacaggtgcccgccaccacgcctggctaatttttgtatttttagtagagacagggtttcaccatgttggccaggctggtcttgaactgctgagctcatgatccgcccgcctcggcctcccaaagtgctgggattacaggcatgagccaccacacctggccaaaacaggtatatcttaaaagctgcccaatgtccatgaatgttacagccttgaatggttcttccaggtgagtttggccaaatgtggcaccatacacccaaggcctgctgcaggctagtgggttgctcacactttaaagctgagacacactcatgccttaaggtaaagggagtgataatctgggcagcagatgttaacttctcaaggcagtcctccttctcttttcctctccagtgacggatggttggaaagcatatatggtgcatttggttagagctgtggccttggtgaatagatacttgggagaatacatgggaatttctcccagggttaatgcaatgcccatgtgttgggaaccaggtgactcttgaagaggtcaggtatttgggagcagtgccttgaaaccttagtggacattagacccacttcctagtggaattgtagcattgaaatccaaggcatgtaggctcttagaggacagagatagtgtgtcattttttcagaattaattaagagcaggccaggcgtggtggctcacacctgtaatccaagccctttgggaggccaaggcaggcagatcacgaggtcaggagatcgagaccactctggctaacacagtgaaaccccgtgtctactaaaaatacaaaaaattagctgggcatggtggcacgctcctgtagtcccagctacttgggaggctgaggtgggagaatagcttgaacccagaaggcggaggttgcagtgagctgaaattgcaccactgcactctagcctggtgacagagtgaggctctgtctcaaaaaaaaaaaagtattaaagaattacataagagcaaagaaccattagaatatctcacttagttgttatcagcctagcaagctgccttgaaggtaatagacatttttaaaagtttatcagatgaaaagcgaaaatcagccaacctgttttaatgaaggtgtgtcctgggctgatttacatgtctccagggactgatggctctagaatgtaaagcttggcatcctgcttgtgttgaatctatcacatttaatttcctgtgggtttcttttttttttctttttcactttaaagttgtgttcttttcatgtgaagttaaactcacatacctttttttaatctccttgccagccaaatgataaatgccaacccagagaatgcagtaaccatgactgccactggaatgaagagggggttataatcaccctccttaatcattgagaaacttttgtccaattctgaaagagaaatcagtaaggcacatagcatgagaccaccagcattatttccttagtctatctcatgatatttgacttttttcctccttacatctcccagtagtagcccatttgatgccatttgacagatgaggaaactggcatgggaaggcccctgatgagtctacagcataggcaaagactggaccagccttgctagtctaatgcctacagaatctcaatgcccagatttgtggttcatagagttcctgaaaatgcacctaaaaatgttggcaagaatggtcatcgttgtatttagctccatggacttgttcaatgactggaactctgaaacacagagaagagctaaaagcctaatacaacttcaggaaaaataaaagccaatgatctgaactggataattcaccagtcaaaggaaatcattaatgcttttactttaaagcagttgtgcaaaaataagcacttgatttttacatgccaaggacctgcactaatttctttccaatgcagtagttaccacttccctctacttccttcacgaataagtaaaagggcatgtttagagatactcttgtaagtgtaaactaagttcatttgggagcctctatttgaaaatactggtataaaaaaaaatctgtctcctgatactaacatttgaaggaatctacttttttacatattggcagagggtctgattctatccttagttcttcccattactttgatgaaccttttcaaggtgatttgatccccacacccaaatatatgattgagagaaggctcaagttcccaggagctccagacagaaggtacctgttggcttgatgaagatgaggaggaaatgaacactagctaggccttaaagggaaatgtctctgataggcctaatacacagtcctctgctaaaggcctccctgcctctctctgctcatccactctactccctggccctgggcacgcagcacacagagatcagcatttctgacagcttctgtagatcctaccatttaaagacttttgtcatccatgcagatagtctcaggagcagacacaggtagctattctttcacatgctagcttaacatgcatttgctttagcacctattgccaggcactgtgtcaggtggagggtatacaaagatgaacaagacatgattcttctcatatacagatagattttggaggcattagcttagtgatgattcaggagtatccattatttggggaagtaggtggtcattagtgaccttttacaggcatttcaatgggctaacagagatgttagattgtagtggaatagaagaatgggtaaaaagtaaatcagtgagttcagattttaggagttaagatggcaagaggtgagaacaaaaaaaggaaatgattgtcattaaaggaggaggaaagaccagccaaagattttacagtgagttaagcatacaaatttatttctaggccacatattcttagcaaaacaacatgtaaatgtttatgtatgtctttcctcatatctgctcatccatcagctccatcgttaagatttcagttttccaggacaaacttactcactttgacatattggactaggatttgaccagattccagatgattcacaaatggttttcttcttcccaattaactcagttccttctgagcagatgaaggtacatgcagaggtaaagctgaagctggccaggggatggctacagttcatgatccccaaatctggtgctgatagaggctcacactgaatcacttcaatgaaaaagaaaaaaaaaaaaaagacaaaacagtatttctgagtagagaccctcccttgagcaaaggatttttagccaaagctgcctgactacattacttgtgatattgcttccaggctttattttcttgagaatgatggtgggtggtgaatgagagatgaaggcaaggaagcattgaaagctgtggggagaggagtagctactccaggctgctgccctagctaaggtgaccctccccttctgctggaagtaccatgccatatggcctctgcatcaagggctcttatgggatattctcagagaatctctgccgtttcatctgttctgatatctacccaagcattttgaaaaacatcccaattcactgaagcaagtccaacttccgtaaattccagtaggtgggttgacagttttataatttcaataagggattttgatagcacttctaagaattaaactacttaaactaatgcatcaggagcatacttgtagaaaagttaaccaaaacttcgtaagttcagatgacattggttttctcccatatggagataaggttggcagttaaaaatgaaaaaaaaaaaaaaacctaccttatttcaaacttgaaaagatcaagagattgtgtttttgtttttcagttgttattctcctaaaagtttatgcatgaggaaaagtaaaagtgattttaagaataagccaaataaaacaaccaagaaagacctccactaccctgggaaggaaactggttggtattaagtaggacaccacataaaacaggtgttattgagaggagaagaaccaaaatgtaactgaggttcaacaagacattatttatgcaatggcaatgagaaaaataaaaaacacagtataaccatgctgtattgctataagtcatgttacacactgggagatggcttcaggggtatttggtttttactttttgtttgggaggtttttcaaaaaaatttagttagaataagtcctttgagaaacatcacagtaggttaaacaaagttaggttaaattaggctcctaagtttgacttctcagcaaacttctactgaatgttctgactgtaagcccaggattgcatgacaaaacctctagtctgaagttactcaccttgacaggttggttctggagatgaccagtttccaaatggtccacaggtggtttcttcaatcccagttaagtttgttccttcagagcagctgaaggcacactgtgagctgaagctgaagtttcccaaagggtgagtacagtccatggtacccagctctggggcctccaaaggctcacactgaatcacttcaatagggaaagaaacagtatggggaagagttaagaggaactgacgcctggatttgaatcctagccctgccacttgataaccatgtgcctttaaacaaggttacttgaaccctccaacttcagtttcttcatctatataagaggaataatgaaattgtgttatctttatcaaattgatatggaaactaaatgtaattcaattagcataagtcaaggaccttagaacaaagcctgactcatcagaaattctaagtaaacattagctagtcttcatattattatcttcagcattatctgtagtgagaatccttaaagccaaataggtgtaactgggaatgaccagcttagtcgggaaataactatcacatcagagcccctgagtctactagagtattgggagcaagatgttcagagaaagagtgggtctccataataagccttctttgcaaggagagaatataaaagtctaggaagcattttgacctcaattctgtcttctattctagctcagttccagaattttaactcttttgattttgacaaccctctccagaaactgtatctatttccctgttctgattggtggtacaataggtaaatttaagacttggaaatcaaagttttcacattttagaccctgccatgccatttagtaaacagtacaactttcatgtcttattcctcatctgtcaaatttaagccattattgctaccttgctctagagacttcaaggaagaatggactcaaggaatcagaagaatttttgtatttggaaactatatgagatgagattagggagaaacatgggaactaagagaaaatgttatcttttttcattgatttaaagagtatctattatatatcaagcattactctggggcttgaagagcttagatttcaccctgtaggacaaaatggtaggtagaaattaatgggtggattgtcatgtatgtgtgatgtgttttaattgcttttaattgatcagtctccctgtagtatgaataatgtatttgaggggagctaatttaaaattgtggaactcatctaataaactattgcaagaatctagaagaaagataatgacggcaatggtagtagagttgacaagtggaagacaaattagaaaaacactaagttgtaaaaattggtagaatgttaccctgcataaatgttgggggagttaagagagtctcataccagggtgcccatgtaaatggtgattccacatactgagataagaaatacgaagagaaaagctgactgggaacaattggttttatagtcttttaaacatcccaaaggacatccttagcatatttgagttcagagctggagataggcttatcagtccaaagatcacatagatttgtgagtccgcaaaagtcagtaagtttgaccaaaggatacatgtagattagagtcagaagagcaatatacaaaagacaaaagctgagaaattatagtagtttatggtcctggataagtgctcatgaaggatctcaggagaaatgatcacaggtagaaagaatgagaaaagagtgatatgagagaaaccaagacaaagaaaagtaaaatgttaaaaatgagtgaaataggcataccaataattaaaaatgagtaaaataggcataccaataacataagggttaaaaaatagagttcaaaaatggggtgagggtaaagtattaggaaggagtcatggcccagggatcaagtgaaatgagttagatctatagatctatttcagttggttgacatttaaatgtattttggttttaattctttattgtttacaaacattgcttttttaaaaaattaaattgtccaattcaattcaggctcacaagcaagtgcctcatatatacaggcattttgtggatcccaaagatgcaatgataaataggacacttactgatctcaagaagttttcagtaccagaggagacggacaagtgaacagatgacttcaacataagtgggagaaatgaggaagaaatatgtggagctatcagaactaagaaagcttcctagaagaaactgtctttgaacaatgtcttaaagatgacatgttttttggccatgtgcaaaatgagagagaaggccaccagcaaagtcagtgtgctacagagcacatgtgttaagtgtggagaactgcaagaaggaaaggaactactagaaggaaaaagcaagatactttctgggtaactcagcctcctaatgataaatggcatagtttcttccagaccttagagttctaattaatctaacaagctcattagatcgtgagcttcttgagagcgggaatctaccatgctaattccttatggtaaccctgacagcttttatcccaacactgtgcttcttgtggtactcaaaaagacttgttgagaagtgagtcgaaacttcatgctgacttatgaaatctttacggaaaggtaacaatattgtgaaagcagagctttctgatcaaaacttcccatttctcagagtggctagtatcattttgttccaaccagcttcatgataagctataatgattcctgtgactttacctaagaagaagcaaagaaaggaaagagacttaccaaactgacactggggcccatagtaccccacatcacagttgcaggtgtaattattgatgatttctacacattctccatggccactgcatgaccagggctggcaagaagctttaaggaggtcagaaaaaaaatattttaatgtgattacattttagtactcaaagtcatttctttagacatagataaccttttgtctgagatgatttaaataatcaggaaaggtttatttgtaaattcatagcataaaaatcatatgctaaaatttttacgtataaaatacactaagcatatagtcataggcatttatttgcttttggaatgaaattaccaatactaatattctgtaacacttataggaaacttagtggcataccttgaaactcttgaaattacttgtttttaatgagtgagaaggttaaatgatgacctgacctcaatcatttctgcatgcaattatttcttggcaatccctttctttatagaaatcaaagattaaaaagtccaaatttgctaaaacggtagagtccaatttataagagaccaaattaactatggttcattattaaaacatcacttggaaaatgctggctgttttggaattgtagaagattttacagaaatattcatacaccaaagatagtgcaatttttatataaaattatataaggttagaccaagaaggaagcacgcagcaccacactctctacttcacaatgtgaaaactgaggtgatgtgagcctaagtttccaactggccccagctgtcagcttctcctcccctgccttattatcaaaggcactgattgtctagctcttcctctgtacttcctacgtagatctatcattttgatgtaacttgatttaggggtatagcttttgtgcacagggacaaatcttacacaccaaaaattcttaggagtgacacgatgcaagattatatagagggctagatgtattttagaatgaaccagaagctgttctcatccccccacctttccatggggtaaatctgagtattctcttaaccgtggcccttcctgagtctgaggcagcatagccgtcttgtcactccctacctgtgtaacagagggctgcctttagtttgtggcaggcgtcatcgttccatttgcctgcatctttgtttctcttgatatagatctccacgcagtcctccttgttcttcttgttgttgggctcaccatctccccagttctctgcttcttcagtaagagatttgttggttcccacccacgtccatattcctcctatcttccggattcctatccagtagtaagaacgactgaaaggcagagtcttctccagatactcaatttccgccttgttttgtatggcaactaaatctgtgtaattgtctcggcagaatcttctagccctttgccagttcatgggtttttcagaataatggtaagtccagcagtcggttccatgatgtgccaggaaatctgcaagacatcagtgtgacctatgcagacttacataatgttacagctaaaaagaacctagcactactccaggctgagctagacacttagagatgaggaaacagagcctaagagtgtatgtgaccatctcaggatcacagaatagttgtttgcagatttgaagtagaacctagaccttctggcttgaatataagatgcttttatctaaggttctatttgaaacaaatttagtggttttctaggtttattttcttattaatttttttctcaaaattatttcaggtgaaatttaaccaacatattttagacattcatatttctttttctttgtagctgttaatgatttacaactaattaccgtgtaatatcatataactatacaatttacgtatactttttaatcctggaatcatttcttgaaggccaacacatatgtacctatgggagaagcataataaggacaggaagaacagtgacatacttttaagtaacctcttttacataaaaaacattttattttaccataggaagaactgcttctggaaaagcccaatataccactcaactcttatatatctaactgtataatttttaaaaagaacaatttacaaagccaaatggtataggattatgaaattcattagatcatgttctatacacaaagagactcaactgatgatgtttaataaacatatggacccatcaaatatgagggctttgaagatatctaattaaacacataattacacaatgacttcataataatatatggcattctaagcatggtatgatctacatgaatcactatttaatacagtaaagaaacagatataattgatggtaaagagcatcataaaataaacattttgaacagagttttgaatgagcattccactagaatgcaagttctaagagggaaaaaactgttgtgtccactgctgtatccttagtgcctagcataaatttcacacattgtagggactcagaaaatacctgttgtatgaaaagagcactaagtttctatgtgacacagtgcagacatggcataaggaatgtgtgaacgggagagttagcatgtttgcttggctagagctgaaaatccaggctagggagaaagaagacattagtttacttaggaaatgaaaaaccaagttcaaagctattgctggagagtcttcaagaatcagatataaaatttgtcacaacaatgggagaaggaccaaaaaatgataaacccccgtcccttaataagctcgtattgtaattgtagaaatgacattaatgtacactgaactatgaataaaaaatagaaaatgaggtgctaaatatttggtacagattgtaagtaccttaacagagatttcttaattaacattattcctttataattgagggattttgtggggttattgggatttgaactctacagcatgggctattataggttaaaaatagtgttcaggagtttctggggaagaactaaaggtaagaagaaaagagatgtttacagaagggatagaattaacagctctgtgaaataattttcccttagactatgtataactagtggatatttaagaaaaatgaatataagtaaaatagacttagcgatatataaatatcataacataccacaacagagcattgtccacccccacaacttgaagatgttccataagtccctctgggtgctctgacatttccatggaaatatctgcaaatgaaatacaaaattatatttagatgtatactcttaaaccacacatttatagcctttgaggtggtgcttacaactttcttaataatcagaataaaacacatatgtctactaaccctgtctgaggtaacaggtttctcagacatagatgaaaaattacttcaaatttacatcagaactgatgcacagttttgttttgttctattttatttttacgctttagtctcaagttgctaatcggtactgccctgaattttttctatggtttggtaatttttatacctgcttttctgctgagctattagataaaactatttaatatttactatgtatattttttaaagtattgttgctgcttaattaactattgatgcttatatttaatgttatagcctcactcttgatcataatgggtcaatgcctcaaatacctaaaaaaaaaaaaaattagatagccagacaccaggaaagaaaagtatttctttttttaataaaaagaaatacctttttgagcaactgaaatgacaaagtcacaaatttcctgcacaccttaaaatatacttaatgtaaatgacgagttaatgggtgcagcacaccaacatggcacatgtatacatgtgtgacaaacctgtatgttgtgcacatgtaccctagaacttaaagtataattttaaaaaaattctatcttccaaagcatatcacttctcaggtagacacagtgtttattgcaaaagatctgatttcaatagtatttcttcaagagtctccccagagacaaagtcaagaagaggaaatcagcatatctgagaagaaagatttcaggatcactttttttgagggtctgagaaaatgtttagtttctatattatttaaaaccagaattgaaatggggtgattcctatccttgccacctgcctctacaaccccaagagtttctatctgagcatctaaacgtcttttaggctgaaaggctcaccatggctttgcttggtccttctctagttcttctgcagcccattgagcctcttgacttagcacaagggtctcaggtccttgcccaaagggagtgtgctgtgctgcaggtagactgcactgaatgtcaacagaaagccttgctttctttcatttctctaacccagtctcacatcctcctcctcctccccttttccctccccttcctcctgcacttctctttcctctttccccacccctttcctagactggcctctattgcctcccactgagacaaaaatgaactgctgatcagaaagtaatgtgactagattctctcttccttccctcctttctatccttccttccattctcctatgcatctttccttaccctcctcctccttcactcattgttgttgctgttcttcttcctcttctttttcctcctgctcctcttcttctacttgttcttgttcttgtttttgtttggttcttgttctcctcttcctccttctctctctcctcctcctccttcttttccaccaccctcccctatctttttcataaatgctaaactaactcttggctacctgtggtaaatggcccttggaaattgcaaatactacaaatcaaaactgcatttcagacatatttatgatgtttgcaaaacttcagtagagctaagcagtggacttgactcgtttcggttccttcacctccgtctttccttgctcaccacctagtggacgtccttgttagtggcacttcctgaagttaacccctgaagagagcccatgctctctagcttttcaccgtgtaggtttgggagcctacaagtacctttaatattcttggactataaaatgagatggttttataagactgcatgtgaaattaggacccatatgatgaaggacaataaaaaggaagacccactgatgtgagtcaatgagtcaaatgcaaatcagatttgcatttttaggaaaataataataacaacaacaaaaactctgaagctcagcgccccatatttattatattgtttaatctttataacagctctctgctatagatatgattattatccccattctaaagagtctcaaagaggttaagaaacaaattcaaaaactagcgaaagacaagaaataactaagatcagagcagaaccataggaggtagagacacgaaaaagccttcaaaaaatcaataaatccaggagctgcattttgaaaagattaacaaaatagatggaccactagctagactaataagaaagaagaatcaatagacacaataaaaaatggtaaaggggatattaccactgatcccgtagaaatacaaactaccatcagagattactataaacatctttacacaaataaactagaaaatctagaagaaatggataaattcctggacacatacaccctcccaagactaaaccaggaagaagtcaaatccctgaatagactaataacaagttctgaaattaaggcagcaattaatagcctaccaactaaaaaaagcccaggaccagatggattcacagccaaattctaccagaggtacaaagaggtgctggtaccattccttctgaaactattccagagaatagaaaaagaggaactcctccctcactcattttatgaggccagcatcatcctgatactaaaacctggcagagacacaacaaaaaaagaaaatttcaggccaatatccctgatgaacatcattgcgaaaatactcaataaaatacggcaaactgaatccagcagcacatcaaaaagcttatcaaccacaatcaagttggcttcatccctggaatgcaaggctggttcaacatacacaaatcaataaacagaatccattacgtaaacagaaccaatcacaaaaaccacgtgattatctcaatagatgcagaaaaggccttggataaaattcaacaccccttcatgctaaaaactctcaataaactaggtattgatggaacgtatctcaaaataataagagctatttatgacaaacccacagccaatagcatactgaatgggcaaaaactgaaagcgttccctttaaaaactggcacaagacaagtatgcctctctcaccactcctgttcaacatagtattggaagttctggccagggcaatcaggcaagagaaagaaataaagtgtattcaaatagaagagaggaagtcaaattgtgtctgtttgcagatgacatgattgtatatttagaaaatcccattgtctcagcccaaaatctccttaaactgatcagcaacttcagcaaagtctcaggttacaaaatcaatgtgaaaaaatcacaagaattcctatacagcaataatagacaaacagagagccaaatcatgagtgaactcccattcacgattgctacaaagagaataaaatacctaggaatccaacttacaaggaatgtgaaggacctattcaaggagaactacaaaccactgctcaaggaaataagagaggacacaaatgaatggaaaaacattccatgctcatgggtaggaagaatcaatatcatgaaaatgaccatactgcccaaggtaatttatagattcagtgctatccccatcaagctactactgacttttttcacagaattagaaaaaaactactttaaatttcatatggaaccaaaaaagagcttgtatagccaagacaatcctaagcaaaaagaacaaagctggaggcatcatgctacctgacttcaaactatactacaaggctatagtaaccaaaacagcatggtgctggtacaaaaacagatatatggaccaacggaacagaacagaggcatcagaaataacaccacacatctacaaccatctgatctttgacaaagctgacaaaaagaagcaattgggaaaggattccccatttaataaatgatgttgggaaaactggctagccatatgcagaaaactgaaactggatcccttccttacaccttatataaaaattaactcaagatggattaaagacttaaatggaagacctaaaaccataaaaattctaggagaaaacctaggcaataccattcaggacgtaggtatgggcaaagacttcatgactaaaacaccaaaagcaacagcaacaaaagccaaaattgacaaatgggatctaattaaactaaagagcttctgcacagtagaaaaaaaaaaactatcatcaaagtgaacaggaaacctacagaatgggagaaaatttttgcaatctattcacctgacaaagggctaatatccaaaatctacaagaaacttaaacaaatttacaagaaaaaacaaacaacaccatcaaaaagtgagtgaaggatatgaacagatgcttctcaaaagaagaagtttatgcagtcaacaaacatatgaaaaaaagctcatcatcactggtcattagagaaatgcaaatcaaaaccacaatgagatgccatctcatgccagttagaatggcgattattaaaaagtcaggaaacaacagatgctggagaggatgtggagaaataagaatgctttttacagtgttggtggaagtgtaaattagttcaatcattgtggaagacaatgtggcgatttctcaaggatctataactagaaaaaccatttgacccagcaatcccattactgggtatatacccaaaggattataaatcattctacgataaagacacatgcacacttatgtttattgaggcactattcacaacagcaaagagttggaaccaacccaaatgcccaccaatgataaactggataaagatgatgtggcacatatacatcatggaatactatacagccataaaaaaggatgagttcatgtcctttgcagggacatggatgaagctggaaaccgtcattctcagcaaactaacactggaacagaaaaccaaacattacccattctcactcataagtgggagttgaacaatgagaacacatggacacagggaggggaacatcacacactggggcatgtcaggggatgtggggctaggggaggaacagcattaggagaaatacctaatgtagatgacaggttgatgaatgcagcaaaccaccatggcacatgtatacctatgtaacaaacctgcacgttctgctcatgtatcccagaaattaaagtataatttaaaaaaagtttaaaaaaagaaagttgccttagtcacataactagtaagagacatggttgggaatttgaacagaggccaatcagttccaaatccatgctcttgatcattaagctgaacttatggcaggaacttggaagacatggtaaaatggggaaaaacgtggagccagggagacttgtgaaagtgccagtgctcccactataccctgaaagaagtatctagacttacttttttctaagtcctctcctctaattctctcaatctctctctctctttctctaagagatgggaatgctgctctgtcactcaggctagagtgcagtggtgcgatcatagctcattgcactcaaggaatcctagggtctagtgccccttctccctcagcctcccatgtagctaagactacaggcacatgccccaaccctcgactaatttttttattttttatttttgtagagacaggatctcactatgttgctcaggctgtaattctgtcttgaagcttgtccaatcaggctttcagccacaccaattccctgagactgctctcaccaaggtcctacacttcactaacacaaacagcctattctccatcctcatcttacttcaccagggagctcctggttttcctcctacttcactggctatttcttctgtatcatgtgttgattctccctcatctccccaacctccaaacccttggagtactccagagatcaccgctttgctcttctgtgtctaacctcactaacttggtggtccaattcacactcttgactttgaataccatttaaatgcgaacgaattctaaattctgtacaaccagaaccattctcctgtagccaaatgcctactcaacatctccatccccaaacaaatttagttgttcaataagcctctcatattttacatatcccaaactgaacttctgaatttctcctccaatctgtagggctcttcccacagcctttccatctcagtggattataactccatccttccagttactcagaccaaaacttttggagttaactgagacacctctcttttttttcacaagtcatatccaatgtgtcaacaaattttggtagtggaaatattgcgggattttttaagaaatcagagagaccgatggggttcaggaggatatttattatttaggtgcactggccaagtcagattaacatccaaaggactgagccctgaacaaagagttaagttaccttttaagcattttgtggggtgggagagaggggtatctgtgcagggggaagcatactacagaagtgagaaataaagacagttattcaattaattgagacatgcattacatcatttcttacttttcaagaagaaacatgttttgcgacttgagtttatctgtctagtgaccttgcagctgcacagctagagaaacagggtcttcacaatgcctgggaaaggaggagaggtaagtctcactagccacagaaaaacaggcagttaatttttaaagggctccagctctttctctttctcagggggagttgggttttgttacatacaactgagtttccgcttacacattatttaatttcttttaattcctgttccaaaagaagccagatacaaaaggttacatgttgtctgattccatttatatgaaacatatagaagaggtaaatccatagagacagaaagtagattagaggttcccaggggctgaggaagaaatggggactaactgcttatagggtacagagttttcttctgataaaaatattttggaactagatagacattttgttaggccattcttgcattgttataaagaattacctgagacttggtaatttataaagaaaagatgtttaattggcttacacttctgcaagctttacaggaagcatggtgccgatatctgctcagcttctggtaaggcctcaggaagcttacaatcatggcagaaggtgaaaggggagcaggcatatcacatagcaaaagcaggagcaagagagggatgtggggaggtgacagtcacttttaaacagccagatcttgtgagaactcattcactatcatgaagacagtaccaagaggatggtactaaatcattcatgagaaaccccaccctcatgatcaaatcacctcccaccaggccccacctccaacactggggattacaatttgacatgagatttgagtgagaacacggatccaaaccatatcagagatggtggttatacaatgcgataaacgtcactggattgtacactttaagatggttgttttatgttgtgtgaacttcacctcaataaaaaaaaatatttaatgtacattcagccaaaagaagatttggaataggaaaggtcatggagatatattaacagccatttgatgggtggtaaggaaaagagtggttattagactgttttgtggccctcaaaaggtagaactagatcgagttggtgagcattataaaaccatcacaaaaccctggagagaggacccagtgctgaagaaccgtttgcctgccatgagacatgagggaagtaccagtgaatgccattgaaagcagcatccctgggtccaagggatggtcaaaggaccactacccaacccttccctagcctacgcctccattacagatgaccgcaagatttatttgctcattgctgccaaccaaggctgcactcactgcagttgctatcagtttatcatgggtaaaaggaatgtgcagtagagaactaactaactgcccacctacctccacaatcctatcaggacaaatcaccatggctcacatttccttacatttggcatgtaagcccctcttactgtctgtcatctatctcctacacagttcacctaaactgttctctcctgacccaaccttgattttcatcccaaatgcttccttgccatctctgggattcctgtcttcaccatcaccaaactcccctcaatcttccagtttcctgttcaaacttttctcctacctccttgctttgtcattagcccgactgcctccctaggacatcacttcccctgcagatctctcaagatgacaatatttattctccacacagcacatacttcagggttggaaggcaggggcaatcttctcctttataatgagtgcctcttatatatgtttattcatctgccctcttgtaaaacacacacacacacacacacaaagaagaaataaaataactctgcttctttgaagcttgtgacactgagataaaccatctcactgtcctcattgtagtgacctctcaactcctcatgcaagattggctttggcacctagttcctgatcttcctttccctgtaagcacttctcatagtcttacgggacttcaccatccatggcacaaccaataccacagcccagatcctcagctctccaatgacattttcctccactagacttgagctacctccttccctaggcacagcctcaacctcgacaacacctaagactgtaccgtctctaaagtcacatgttcaaacacttcactctttaaccactgtctcctattcttgcaagtgtattgctcaagtatctcattgcaatgctttttacttctacctcattgaacctccaggccattaaacatttccttatttctaaccatcaggtttctccttacttgtttgtttgtttatttgtttcttttttttttttttttttgagacagggtctcactctgttgcccaggctggagtgcagtggtatgatctcggctcactgcagcctccatctccctggttcaagtgattctcatgtctcagcctcccgagtagctgggactacaggtgcatgccactacgcctggctaagattttgtatttttattagagaaggggttttgccatgttggccaagctggtctcgaactcctaacctcaggtgatccacctgcctcagcctcccaaagtgctgagattataggcatgagccactatgccccacctggtttctccttatttatttcaagtctatgctgcactattaaaactgccttgacaaaaattataatagtgagaaaattatgacagtgaaagagatctgaaataatcaacccccatcttgcctttaccttccagactgcccttaataattcctgagcttgggccaagctatctttggcagaaatttagtttatagtttaaatgataatagcccttctccaaaactaaactgcctttgtaaaactaataaaagaccaccaatgaaaggttaggaggatgagaggagcctgaattctgctaaggtgtagatgtaaacaattaccaactgttattccggaggtcacaagatttgcaacatcgccaattactcctgcagataacagcactatcatagaatctgattggccttttgagatgtcttttcagattcttacatttcaactggtggctctacctggacccatcaacaagtcctgtggctccacccagaagcagacttaacatgcacaaggaccattttccacaccgctatgattgcatcccaaccaatcagcagcaaccattcctctgcctgccaaattatccttgaaaaatcttagccttagaattttgggggaggctgatttcagtaataacaaaaccccggtctcccatttggctggctctgcatgaattaaattctttctctattgcagttcccatcttgataaatcacctttatctgggcagcaaacaaaaggaacccattggacagttacactgttggcagatatatcttgcttccaaaattggatttttgtttaatgaatttattctgttttcttgatatttacaactgtgaatgttgtgtctgaattctctttatttcttgttgaaaagaactatattgctacagccagtacatacagatggatagctaattactcaacacggggggatgtgaccatcaccgcactgtgcaaatgaatgttacccattgtccacttttcccaaactacatagtgttatatggtatatgacccaatcaacggtggcaaagctccagaaataccacatagacatcagggacactttaaactaatcagcctatagtcctttttcagtaatttccaaacctggttgtgcatccaaatcacttggtaacattaaaaaaacaaaaaaatatacacgcaacattcgctcccaatcctactgaatcagaatattttgggttggttcaggaacattcaggagtttttcagggtccaaggtttatataatttgaggtctctctttgagaaaaggaacgtaaaagcgtcttgcttttatagatcttacaaagatgtattaccatgtaaacacattcctaggacccaggcccttgtaatttaaaggtttatctaagtaatgggccctgaagcttaattttcattatcttcagggcaaattacctgtgggttagggtttaggaatatatctctctgtgtatgtgtgtgcacattagcatgtacgcttgtgtggattttttttttttttttttttttttctgagacagagtctcgctctgtcgccaggctggagtgcagtggcgtgatctctgctcactgcaaactccgcctcccaggctcaagcgattcttctgcctcagcctcttgagtagctgggactataggcacgcaccactatgcccagctaatttttgtatttttagtagagttggggtttcgccatgttggccaggatggtcttgatctcttgacctcgtgatccacccgcctccacctcccaaagtgctgggattacaggcgtgagtcaccatgcccagcacttgtgtggatgttttaagctcccaggtgagtgaatacaaaactagatctttcccttctgtagcatctgtactgtttactctatgcatctcaatattttttcttttagtatctttcctttttctctcttattacttcctcttgtgctatttttacacctccttttttaaaaaattttttcccttttatttctattgacctttagccctcacaatgattcctacaagccccatttctgtaaatggggattgaaataattgctggacttttgagagatagatatattaaattgcaaactggcagtagtgggggcagttgatacataactaggttttaaagtctagccttctgagaccactcattccatttgtgaaaagtgattctacttcttattatgagccaaaatatgcattcattcacccatgcattgatttattcattcaataaatatttgttggatgtccactctgtatcaggaatgtgctaggttctgggaatacagcaatgaacaaggtaatttttccctacccctaaggaacttagagtttagtggggaagacagacattaaacaaacaattgtgcaagtaataatctataattatttattacaattaaaggaaggaagagacatatggattatgagggcattaaagaggagacctagtgtaagtagccagttctcgtgaagggacatgtattagttggagttctccagagaaacagaaccaatggtgtgtgtgtgtgtgtgtgcgtgtgtgcgtgtgtgtgttggggtgtgggggtgtggtattttttatagaaattgtctcacacaattatggaagctgagaagtcccatggcctgctgtctacgagctgagaaccaggaaagccagtggaatacttcaaagtccaaaggccctggaaccaagagtgccagtgttggaaggcaggagaagatgggtgtcccagcttaaaaagacagtgaattcactctttttgctctacatagggcctcaatgggttggatcatggccacccacattggtgaaggcaatcctcttagtctaccaattaaatactaatctctttggaaatactctcacagacacactgagaaataatgttttatcagggtgatagaaatcttctggagttaaacaatggtgatagctgtacaatcacatacatttttaaagggtgcgttttatggaaagtgagttttatctaaataaaatttctaagaaagagacttaacacagagataaacataagcacatttattgtcaacctttatagtgttatgtcaaataggtctgacataagcttaaataaatatatactttaaaaattataaaatattttaagttataatttaaaattctcaataaaactcaaacacaaaccacactggtatttcacacagctaatttctaatgcagtttacataaatatttacaacacttaaacaatttcaaagaaaataacactgtattccatacatagcctgatcacagtagttgttctctcttatttcccagagtttttctgcccctttaaaagaacctctgctgttctgatccttatcacatctctgttttgactgttggctttgttgttgccagtgttcagccagaacttctctgaaacttttttttcaacacatgctaagttaatggaagtgtaggagagttttgattctcacactcctcaaggctagagcagctttggcaattactgactgagaatttttcattgccagtgatcaactgaaaactggagattcctttggaattgttaaatctgcttataaataaacataaatgcttgctcacacaggcattcctctcttccagagcaccctaacatacagaagaaaacaaatagggaataactattagacatcttcattcgttaaaaatctaccagatgactcttttacatggtgagtttctattgtgaatttaaaatcttccataatatacaagaattatgtttacatatcatatctgacaaacatctttgtaggaatgcaaagcacatccatctttctgtattcttttccaacaaagacattcataaaattatacctttgtgtgtttgcatttatgcttttattagttcaaaacgtttggcctcatggaagtttttcatcgtggaaaccacatatttctgaaaaaatatctgacaatatacaaaccttccattcagtttttactctccaattctaccatgttttcaaaaaacaactgtagtaaaaacactcagaactttattctggttaacatcatgccttgctaggggacaatagtttccctttttgaaataaatttaaaacagatgtaacataatttgttaataaacaatgagggggtaatctagaataagtaacttttaccatatcatagttgacagcatttacaagttttttaagtccctaccacacttgtattgaatgaagaagtatggaagattataatatattcaatgcaagtaaaaatatcacaatccttaagaactctttaagaagcactgaatcccatagggatgaaagtgattaaattgtgcatagtaaccctcgcacagagcattcagtaggatttgcaccattaacaaccctccatgcatttgcctgtgggcattcaacatctgtcatttttttaagttataatatttttagtcatttttttcctctaaactctggataattattattcattcttatgacagcaactgtgtaatcagctgtcgaaacactgtgaagggcaaaagaaagaaagccacaaaatattgtgtttctgtgccaagattttacagcgagcaagggagagttagaaaaggaattctgagatttcagagtcttggtctcttcacctttgcttggaagaaaatatcctttcccttcattagccaacactttcttgatcctgagagtaggaaagggaacactgagtcttttcagttgaaggccgtccttgcctgctggactttgatctattgaagtggtgatgggtgttgcggtttcagccataaaggcatctggcatagtaggcaagaagggccagagacccgaggagagttatctgtctctgttaacttcagtgtatccctctagttccccagatgcacctgtttctgtaaatataaacatgcatgtcatcagaacacttaatattctgcatactgatcatgacaacaaaatgtaccttctaacacagacactctcactaggatagaccatgtaggaacatcgaattctattcagttaggacagtgatgatgtctacatattatacctctgtcaaaacctacagaatatacaacacagcacagagtgaattctaatgtagcctgtggacattaatgaataataatgtatcaatattggcccatcagttgtaacactaatataagatgttaataacagggggaattgaaggggtggtggggagatatgttggaactctttgtgctttctgctcaatttttctgtaaacttaaaaccgcacacacaaaaaaagttattttaattttttaaaaagtattcagagggacttgacctttccaaattctctcaaagcaggtcggagtagttaagaacacaaattttagaaccagactgccagagtttgaatcctggctacaccacttactagctttgagatttcagacaatttacttaacttctctgtctcattttcttcatctgtgtgataagaaataaagtaacaggccaggcccagtggctcacgcctgtaatcccagcactttgagaggccaaggcgggtggatcaggagttcaagatcagcctggccaacatgacgaaaaaatacaaaatctctactaaaaatacaaaaattagctgggtgtggtggcaggcacctgtaatcccagctactcaggaggctgaggcaggagaattgcttgaacgcaggaggtggaggttgcagtgagccaagatcatgccactgcactccagtctaggcaacagaatgagactccatctcaaaattaaaaaaaaaaaaagtaaaaagaaaagataagaaatatagtaccagcccctatctcagagttcctagcttagaaaaattcccagaatataataagtgcaatgtaagggtcagctatcttcattattattatctatcataaatgaaattacacaataaagctagatccgtttctttcctctccttctacaaaaaataaagcaactttccagaacaatacccaggtgatgatttctcccctgctccctccctaagatattggcaagtttggagggttcaaggagaaacagagcatgtagagaagatacctctctcataaccatttgtgatttacaagtcttacctgattcttttgaacttaaaggatgtaagaaggcttttggtagcttccatctgattcaaggctttggcagctgctgtggaatacatgagaacactaggtaaagcactgtcttccaacatgaagagagaaaaatatgtggaatgttcaatggcatgctttgtataagaatgcaacttacctggcaggaacaaatttctttgctgcaaaagaaaagacaaacaaccattaattcagactaaatgacttttaaggatatattaaatccagatacaatatgacttaattcatcaagtgttgcaaactcgatgcttcagggcctctgtaataatcagagcacaagcatggctctgtggcatctagggtaaaatgcaaagtgcacagccatccaaagggcatagcagcttcctaatgccagcaaatagctacggggtcatcttgcccaattcagctcccaatttttcatgagaagtccaaagtcttaatttaaatgtgagatttcctattttgtaaacgtcagaacttaactcaaaaatgttttaagtactcttaaacatgtaagccaaacaaaccatgagtgtagtcagatgtgcttccatattccttatgagagactctcaaatttaagcctgtactccaaataaatctccttaggaagaattttatccattttccttagagtgctcatcatggcagttccattgcacaattccgggaggcatcatataattcaacatgaatagcaccccctggagttgtacaatattaggcacgactaacatttttatttcctgaaacacttcccacactgagttgtactactaactcttttcttaatacttctgcttaattatactgcattttatccagattctaattattgtttaaatcagtaagcaagaccatgacttatcaatgagaaagaaatgtattttcaaaaacatttttgaagtacattcataaacttcctcacctttccgtaagcatttccgaagccagaggagaaatggtgctaatgtcaggagggagagtccagcagcagaaagtccagctaccaagggaatgttggactcagtgggagctaaggaagtaagagacgaagaaaggtcatgaggaagaattgatgttaaagtctctccgtcctgtccctttggccttttttctgtacattcattactaggagcagaagagctatctagtttaatacaagaagcagagatgtggcattacaggcctttgagatctgctccaagccacctttgaagctatttccaccattggcaggcagaactctaacttgccaagctcgttcacaataccacaccacaccttggttaataaacactgcacttgcttgctctcttgctctcactccctcttgttttccatttcccctttctcctctcctctctctgtctcctttttccagttgtcagaattctaccctttccatcaacatgcaacttctgttttttctctatccccatacaacttaatattcacaacttgtcaacctgggcgaactttctggtttggatataatgaatagttgattactgtaacaagatagctccccctttttctttttaatcaccagacaaccaccatcaatcaatgcatcaccttcacaggtaggtagcaggccagaccagtgtcctgtggctccacatgtccgagctgcagagccattgagcgtccatccttcaggacaggcgaacttgcacacagtgccaaacacgggctccccactgcagctcatgttgatctttcccggaactgccaggcttgaacattttaccactgcaaatgttaggtacacaggcagagtttcagaaaaatctactggaaaacttccaaaacttgcttaaaagtcaacaatgaatgtaaagtgtaagcgctacttagttttcagcatgtaggaaattaggaccaaacccctttggggcaatctaggttcagaaactttatgaagtatttgacctgtaccctaaaaaagtctgcactcaattctaccttggcaggaaggaacctcttctgtccattgtccctgagatgtgcactcaagttgagttgatccatgtaattcaaatccctcctcacagctgaaggcacaagaggacttgtaggtgaattctccaataggggaatgagcacacctcaccaaacccttcgggggctggtggacagcatcgcatctcacagctggaacacacgagagagcactttagaagtttgtttgcatctccagcaatacgtttcccaaggtaaccaagttcccaagctcttcaatagttctttttatcttaaaataaaataaaaacaaagactgtaccttcacatgtgggcttctcgttgtcccactcccctgtggggccacattggagccttttggatcccttcaacacaaaaccctgctcacaggagaactcacagctggacccataacggaaactgccagaagcactaggaagacaattcatgtagcctcgctcggggttggacaaggctgtgcactggaaagctgagacatcaaaatgatggtcagaaaatattgcagtggaactagagagtacttggcgtttgttgagtgaacccagttcattcaagcaacacttggagaactgaagattctttataattccctggacaaatgggaagatggctgtgttttctttgaatttcagccccctcactgatcatggcactaattaaaagactaattaatcagaacattagttcctgagcactgttcttctaacacacaaaataaattatggtccaaggaaagatttcacgcagtctgaggacaacatatgggtcatggatgtttatagatggtgccaaaaagaaagaaaagaaagcacccctataaaatttgtctgttttgcagtttggtttttgtgttatgttttgctactggaaatcattctgtgctggctttggctaggacaaggccagtgcctgatagtaaaaactgcttgttttcaatatccttgctctcactttaaagtgaattaaaatttactgcttatatatgcatcaatactatctctgtagctgacaccatgcttgaaacagtctcatcactgctaattatgagccatttcagaagacaggtgtgatgagagttttacattcaaatcatgttctcattattctgctttccgaattttctaatatgattcctttagattaagaattctgtctattccatgctaatgtctacaaagttttatcagcacatcacagttaaaaaaaaacagcaaagaattcattcttaacacatatgatcctttccctggccaaacattagttcttttaaatgaatctcaaagatacgagggttgctcatcaaatctgatttctatagttaaagtgggtattggttttttttttcactgtccaagtttgaagatggttgttctttaagaaagtataaatcgaaggatctcaagcttaccttcacaaactgggatttgctgtgtccactgcccttgagtggtgcattcaacctgggctggtccctgcaacatgaagccttcctcacaggtgaagttgcaggatgatttgaaggtgaactctccagcaggggaatggctgcacctcacagagccattctgaggctggcggacggccctgcatgtcacagctgtaacaaatatacgcattgatattagcacggcctagaattagcttgcccatttccagtatgggttgagagaaagaatgttcacagtaagtctccatgtggaacaactctacctttacacgttggcttctcgttgtcccaattcccagatgaggtacactgaaggctctgggctcccattagttcaaatccttcttcacagtcaaatgtacaggttgtgttccatgggaagcttccagggttttggaaacattccacgaacccattggctggatttgtcacagcatcacactcaaccactgaggattttaaagagcaccatgaattttacagaagaatgatcttttcacttcctattgagctgggtgcctaacagagtgaggaagctgccttcaaagggtagatcccaaagtcctatgtcaattcttagggacatgcacagccagaataaaagcttttattctttttcatggatattctatcttttctgatttccactttgcctatgctgagtggtctctaatctatgttatcatttacgtgaggtaaaaatttaaaaaaaatagattccagattaggagttatgactagtactgacatacgtaggctattcatttattttagcccatcagagcctgaagaactgatttttctttttttggcctctggttcagaaagataaaattaagagagaaaaagagatactaagactgcttgactatcatggtcttaagttagtcccatggcttggaaaagttaaacagggaaacaagatgagaaatccattgagatttctagagctttattgttttatggtctcccttacaaatcaccagagcctcagaaacacccatttcaagcatagaataaaaaaacctctctcaacccaagcaggtactgggttggcaatatacattggctgagagaacaaattgtattaaaaacaaaaacaaaaaaaaaactttccctgaagttttgaaaatgtaagttgaatcaaaaaacagaagcaatgagggatgagttacagaacgttctgtgcattctcagagggatttaccattgcaggctggaataggagcactccattctccagaggacatacactgcatggtctccatgctgcttggcaggtaacccctatcacagctgatagagcaggaagaattgtagctgaagtttcccagtgggtgactgcaaaccaggcttccatgctcaggggattccagggctgtacagttcacaactgaaaaagaaacccaaatcagttctgctcatctctcacctttaacagataagaacactggaaactagaactacagtttggttttttttttttttagtttaaaaatttataaaatttctaatggaatttgtaaaattgactgtaattctaccccttttcttttattcaagaaaatgctgatccataacaacaacaacaaaaaagcagtgatgacaaccataaaaaagaaatattgagtgatatggggagagtagtgtaattgtgtttacctcaaaactgttcaaattatatgaacaaacacagcaaacttaggtaccacaacaaatttcttgttacttttctcacaactgctaaaaatactacagtaagcttccaaccaggatgagaaccattcacaaagctatatttcaaatttaagtactagaatacattacaaattttaaaaccctaatgctgcactgtctactatagtagccactatctgtgtggctactcaaatttaaacttgaattcgttgaaatcaaataacatttaaaattcagttcctcagtgtcaccagccacatttcaagtactcaataaccacatgtggctcataggtacacactggaaaacacagctatggaacatttccattatcacaaaagctctactgcacaacgctgtgctaaggaatcttggagagaagctcatctaactctcttaatgtacaaatttaggaactgagacctcatttcattcaagtgacttgctccatgctacacggctagtcattacagagccagaggccagagcatgaaccaagataccctggactctgtaactcactcatttctactgcaacgtcttgttaccacctagatgaggtgagtacatgttcctcgcagggacacagaattacagtttattgaatgtgtcctgtgtgccaggcaccatgtaaccatgagcctatgaagttcacactattattatcctcattttacaatgagaaaactgacatagagagttaaactatcttgtcaaggtgccaaaataaataactggtgaatctaggactcaaacccagcagggtctgacttcatagtctcagctcacgatcaccatatgacaccatctgcaccagggaagggaaggcatgcagacctgactctaatgccagctaggacgtgagatggtgctaccatctcaagtgaagaaagaggcaagaaccagacttactttgctcacacttgagtccactgaagccagggtcacacttgcaagtgtaattattgatggtctctacacattcaccgtggccactgcaggatgtattggtacaggcagctacggaaaatacaaagcatgatgaggaggactattactgtgcttatactgagtgcctttgattttagaatcaacagtgtgcaacagagacatcagcagtcctacagagtgccatagactttaactgaagtgttttacaaagttccaaatctgagtttcaggcccacctatcctaaaccttgatgctaatgtatagctgtggctggcacctaccgtagaaaatttacttcttcacaaactctgaagacagttcccctaccacaaataaacaagtaattaaaatatgtattgtgtgtgtgcatttttatatgtaaagaactacatatttgcctacagtatttatatatattttatatatatacatacacacatatatgtgtgtatatgtgtgtatgtatatatataaaatgtatataaatgctgtaggctatatatatatacacacacacatatatgtgtgtgtgtatatatgtgtgtgtgtgtatatatatacatatccacatattcttgcccacattcacacaaaacagcaaaagagagaaactttagcagttaaacagaatcttttggaacataaaatgaccacaatagagagcagtttttgcatgctgtaaatttgccaagatgcccacacactgaaactacctcccactgctgccgcaaactccctacctgtgtagcatagggcaagcttcttcttgctgcacctctcatcattccacatgcccacatctttttctctcttgatgtagatctccacgcagtcctcatctttttgcctattgttgggttcacctggagcccagttcttggcttcttctgtcagaggtttctgggttcctacccagacccacacattgttgacttttctgattccaatccagtaataacttggtgaatagctcaatatggagtttaggtactcaatctcttctttgttttgaattgcaaccaggtgtgtgtacctttgctgacaataagcactggcctcatcataagtcatagcttccgtggaggtgttgtaagaccaggctccactctctttaatgagaagcactagtgggagaaaaagaaaagaaatggtagagtttggtactgttgtggtttaactctgacaactgtgctttttattgtcttatttttggcaatgtttgtgacatggcccagacttttctcatcttttcaaaagtaagaagtacgtatgaagaaacagcgacttattgtttatctcttttgtgactgccacccactaggtaccttatccacactcactcacaacattatagtatacccattttgtagtagaataataatcagaataactaagctttattgagcacttagtatgcaccaagaagcactgtatgaggtactttccatgaaccatgctattgaatcctcacaatgcatctgggaaataggtcattatgatccacactttacacttaaggaaagggagacaccaagaggtaaagtaaatgaccccaagcccagggaagaacacattgcaggtagaggtcaaggatgctgccagatatcctgtgcaggacagccccagacaagcaaggatatttcagtctgaaatatctatagtgcgagaatgagaaatcttggtctaatggcactgacttacccaaagtgagagctgagagaaactgtgaagcaatcatgacttcaagagttcttttcacccaaaggtttaggcttgaaatactttcctggggagataaaacacaaaatgaattaaagaaggaaatcgtgggtagctagttacattattctaccatgatgtttaaggcagcatcctaagattttgggcaaaggacactagtgcaataatctttatttcagagtttaatcaaataaataaacaaattttaagactttcattatttaggtcaaagagaaaagacaggttttagctacaatacaataagagcttgtacagatgtggtttttattagaaggccttttgcatatctgtgtttcatggcccgaggctgcccttataaagcgttctgcacttaccgttttgggaagcagttgttcaaacacaggatctctcaggtgggtatcactgctgcctctgtctcaggtcagtataggagttttgatgtgaagtcagccaagaacagctgaacactacttcggctgaggcccttttataggagggattgcttcctgtgaataataggaggatattgtccacatccagtaaagaggaaatccccaatggcatccaaaaactttcccgggaatatccacgatgcttaaaattacaatgatgtcagaaactctgtctcttgaagctacttcacctttgtccatgcctttatatcgtatatgcaattttattaatatgacaaaaatgcatgatttttaattataataacataaagtctatgtctttaaaaagttgtaaaactttgcttgttagtagtgtctctcatgtagttgtggtagtaattagaatttcagaaacagaaggaaaccaagaataggtttgtcatccatagtctactaccttcaatttctcattcatagctgtggataaccaatcactactcattttttcttcctttttcacctgccaattcaacatatttaacatgcactgtctcacagaggaatgactcacaaggtagatattaatcttcagattttgcacggcagttatgcctaaattaaaatattatctaaaaataatatctaacactcaaatggttaaaataatgccttattttaaaaaaagaaaaatgggaaatagatatttacatctgggaaagtttcatggtttgttcagtgaaaaaaataaaaaggaggccaggcacagtggctcacgcctgtaatcccaccactttgggaggccgaggcaggcggatcacctgaggccgggagttcaagaccagcctgaccaacatggagaaacgccatctctactaaaaatacaaaattagctgggcatggtggcgcatgcctgtaatcccagctactcgggaggctgaggcaggagaatcgcttgaacccgggaagtggaggttgcagtgagccaagatcacgccagtgcactccagcctgggaaacgagtgaaactctgtcttaaaaaaaaaaaaaaaaaaagaaaagaaaagaaaaaaaataaaacggaaaactatatatatatatttaattggtcaaaattttgtttaaaatttttgaaatgttaatgtgcaaagaataaaaattcttccacaatgttaacagtgactaactctggatggcaggatttgggataatttttatatccttcattattattttcaggattttaaagtttttttcaatttccctttttttcacctttatagtaacaagaatacagtttaaagaaacttgtctctaggccaggcatgatggctcatgcctgtaatcccagcactttgggaggctgaggtgggtggatcacctgaggtcaggagttccagaccagcgtggccaatatggtgaaaccctgtctctactaaaaatacaaaaattagccggggtgtagtggcgcatgcctgtaatcccagctactggggagcctgatgcaagagaatcgcttgaacccaggaggcagaggttgcagtgagctgaaatcacaccattgcactccagcctgggcgacagagcaagactccatctcaaaaaaaaagaaaaaaagaaaaagaaaagaaaagaaatttgtttccaaatgcaacagaaggagatgtatgtggtatcctatattcctgctcttcattttgacatttcttctgggtgattgtatacattccccatctctgcatcttaccctatctaaatgatggtaacagtaaatggggatcattttaatttccatattctgtaggttttcagagctcaagtcaagctaatattctatatctacagcctttcaaaataggaggtctatctaaaaatgtactgtcagcagacctgaacgagtagtggtaaaagcctcgtttttctctttacttgttagcactggtctttctgtgttcataaagatgtcaagacccaaaaaaaaaacaagaaaagagaagaaaaattccaaaaaagacaactgattagaaaaaaataacttaattaacgaatttaattcaacccctatcaaaaagcatagaatttattccctccaccttaccactctcttacatgatccagatactgacattattccaattctttatcccactttacttagctcaatgtggttgttgcttcaataaattcagaagagtaatcactcatatagtgtttatttagattttagggcagaatgtcaagttgggttaatacattatctgtatgtattttatttttaataaagtatgaatacataatctgctatttttaaaaagcatggtcaaatgtatagagtagccaaatcttaaaaaacaatttatcttcgatatcaataaagtacctaataattatattgctaatagaaattagtcgttaacatccctagataactaactttattattgcgaatttttcataactaagtttatagtttatctcttcccctttttaaaattagttcaaagatatctaaaaatagccccagtggtgatgaagtttctattttacttacatatatatgtcctggacccccaattataatctctaacatttattgagtgcttactatgtgccaggccatattctgagcattttgtatgttcacctattgattattcaatccgtacaacagcctatgaaataggtactcctattatccccattttacagatgaggaaattgagaatctggggattttatctcattcaaaagcacagagctaagggttgaaaccaggcagttgatatccagagcccactcccttacctgctactccaaaccatgatttcttttgttgttatgccccgagattccttgttctacccaagtttcctgtactcttcttgccctcttcttcctgagacatccttgaccatcacagctctccactgagataactgtgtcctgggttctgagacatgggggctggaagggaccccagggacagtgagcagtagggagaggatgcagtgagaacagaccctggatccccggtgcataggcagggagaaagtggacaaaggaaaaaacaagcaaggcaggtggagccatgcctaggtaaagttgatccctaagccacagttcccagaagttcctgattcaaaagcaaattttctctaaggtcaaagggcaaactgattattctaaattctaaactgattatttctaaattgagaaagcttcagggagagatcccaatattcgaaggataagagaaatgaggagtggaagagataggtgagtaacagtaacttaaatgtagactatatataatatataatatatgtagagtatatatatataattacaatatattatatatgtggaatatatatattatttatatatatttatatattttatatatatagatatttttatattttatatataaatatagatatttttatattttatatataaatatagatatttttatatatattatatataaatatatgtaaaatactgtgaaagaagaatagaatcttgagacctcaaattcactatgccaaagggaaagttaagcttgggaaatgagtcatgcaaaaactgccttccttttgttcccaaatacctgtaatttcacatgcttactttatcttatataaaatgtagatgtactgagcatgagatccatgcataatttccctctagtcccttctttttacatgtaaagtgtagactcactgagtgttacagagccttgccacaatgtaaacacttgtctcattgccaacccatctttcgtttattttcttcccctcctgcttgctctttcccctctaaagatggaagttcccaaaactctctttggaaaaagcgcaggtcacagatcctacagtgatttgtgtttcttttacctgggacaaaataaacctctaatctgttgagatatgcttcagttactttttggtttacaatatgtacatgtatgtatataatttatatgtatataatatatgtacttgttttaaccagaggtatgttattcaaaatccattcatccttacaattacctgcattctcccacagtattttctgtgtccctgcccccgaggttgtcactgcaaatcaggtacatggatactgggagctgatgggctcccctctggctacctgggctgctgaaggggccatagacagacccagctttcctctcgtggagaggccctgggccagcgctgcgtgggagtgggattacaaccagactatagcttcttcacctgctttttcctatcaggatttcataagaggcaattgcttgttttttgagggtgggggcaaatcagggggagttgaagaggaaattgggtaagatttgaatagttgggcatgttgaatattatgaatatcatctccctcttcaaataatccaaaatatacccccaagaaacaggctgattagaggtgcttcaaggctccactgaatctcccaagctctgaagatgtagctagctgttaccggattgccggttttcaagcctcgcctcacatggaccctcttggcagtttctcgcatgggggaagcatccgctacatagatgggaatgaaaagaggaaagaagacggtgcaaactcaggcacaccccggtgtctgccaccagtgctatttaatctctgaggtgtcacccttcctggctttattgtctcttcctggaagtctcttgtcctctcctccacaccctttaatcaggcatcaaagactttaaccagttttgctgtgtgcccaggcccactcattctcacttttatggcaaagggagtgggagacagagagatagccagaaagaagagattggggaccccaagacaaatgttagaattttaaccaaggccaccctgtggacaggagattattgggtttagtggaaagcagcactggccacaaccacacgtggcaaaagcatctatcgaggagtgaagttatatttggtgaatgtgaccgggaagcaggggcagtggtgtcctcctgccttcctgaggcactctgttcccttacctctgcgaaggcttattttacccctgagtgcttagttttgaaagccttagttccctctctcccataaaaaagctctactctgctaacatctaagttacctttgcagagtcttaggtagagggaggaaatcccaataaagattccaccctatctgcaaaatacaaacatggtatttcttgcattcccaaaattgtgaaagaaaatgtgtatcaccacagtagagaatggcattttttgtttgatcaaaacctaaatatatttgatgaaaatgtgtctggttctaagtttatttcccagaaagccatgtttactcacttggaatttatagacatcttataatatctgagtcgagtaggagctccgggctctacctcactcttttctcccacacccagggggaagtgtagggttctcagactttagaataaagaggaatcacctggacaactcacctaaaatgcacatcttcaggtctcatactcagaggctctgactcaacaggtctgggtggcgcccaagaatttgggctttaaatgagtatctcagatgattctaatacagaatgtgtaagatgaccagatcctatcacacttagatgtattggcctagggccacctaacttggagaaaatgttagtaagaccccgtggttggtgctcagctataggtaccagaattttgatcaaaatttactatcattgtgacacttctcttcggaactggaaggccagaaccccacttgtaaagtgctgggaaaatacaaggaaaatttagggtgagtagcattttgaattcttacacatggaaagtaaatgtataagaattcttaccaataaaaaaaaagcaagagagaatagctgctaaagaattaacacaaatatgtatatattagttattctcttttctcctctgattccagaggactttgtaattccactaattcttcttgagcttccaggatgatctgagacttgaatttttcatgtgctttttgcttcctatttggcagcatcttatcttgaagtttccgctttctgcttggggacctaaaaactaactaatgggaatttcttcaaaatgagcaaactctggtgaattcccaaagcggaagaaacaagtgaggatcgggctggttaattaagagaacttttcctgaatgtagccagactgtttgccgactgttgttaacatgagggaagaaatacccctggattttagaagagccccttgtttgttttccttggccatttgtgctgcttgttttgtaagtcagaaatttcctgaaggactattattagctttgttctcacgtcagaaaacttctgctctggccacttttaaacatataacttggattttactgtattagaaaatgtaacaattacagacagcactaaaaggacaccaaagggcaaagaaaatgggtaacttttttttcttccccaaatctaaaataggtgattttggagaagtaggagaaaaacctggattttctagatctctttagagctcaacaactgatatagttaattatgtaagtctttgatatttggaaatgattggattaaccggataacaatgaatatttaaatacagtgatttggccaggagcagtggctcatgcctgtaatcccagcatttggggaggctgaggcgggtggatcacctaaggccgggagttccagaccagcctggccaacatggtgaaaccccatctctactaaaaatacaaaattagccaggcgtggtggtgcaagactgtaatcccagcaactcgggaggctgaggcaggagaattgcttgaacccgggaggcagaggttgcagtgagccaagatcacgccattgcactccagcctgggcaacaagagcgaaattccatctcaataaataaataaataaatacagtgatttaacacaagagatttctatttcacactaatgagctctgtcactggggcaagcttctttgcctcattaagtctcagatttcccgagagcttatttatttataccaagagtgctttactaccgtctctgctagctgtgacataatatgacaaaaggtataaatatgggaaaaggcactaatttatatcaaagcgttcttcgtttttccttgctgtgaagtttttagctaataattcataagaatataccatatttagagtgtttactatgcatgggcctggcacttcacatacattgcttcttacaaattttacaaagtgaaaggtagatattaatctcattttatggaggacaagatagagatctggagaggttacataacttgccagtgttttttcagttaataaatggtagggtggagattcaatctgtgttactctaaagtccgtgtcctttttattggctccatgcctactcagatttaaatctcagcagggaagtaaaccttagtttttacatgagaaaatgttacagcagccttctcggcttcctttacccccatcccagtttcacgagcttagtgccttagatcgggttcctttagaagcagacctcgaaataaggatgtgggtgccagtcatttattgaaaagatgatcccaagaaagcctagtaggagagtgaggaagtgagatggggaaaggaagaaactccacaagaagtgtgttaataagcaggttaccgctgtgggcagccatggggctcagctgcactaacaaactctgtctagtacagaaaacctcagggtctccccaaggaggggcaagaagtctgcctagggtatatatccgccaactcagtcactggctgagagctgatcctgggagggcatggttaattcctctgcactttcaagtggattcctgtggtcagaaaaagccctctacaatgaattccagatgcttgtatttaaatctgacatgatctgaatgctgtgttgggacagggtgggcgttattagttttctgtcattactgtaacagattactacaaacctgatggctgcaaacaacacatatttattatgtcatagtttgtgtgggtcagaagtacaggttagctcaactagtttctctgctctaggtttcacattgccaatatcaaggtgtcatccagttgggctcttcttgggaggcttggggatgaatccactttcaagctcattcagattgttggcagaatccagttccttgtggttgcaggaccaaggtccctgttgccttgctggctgttggccaggagtcattcttagcttctagagactacctgtactctctgactcgtgtctccacttcacctttcaaaccagcagcggctagtcgagtccctctcttcaaatgtctccaactgtgccttcacctcatttctcctctgtgtaccatgtctgcctctactgcttgtaagggctcatgggattacattggatttattcaatccaggataatctccatattttaaggctagctgactagtgatcttaattccatctacaaagtcccttccaatagtactgtattagtccattttcatgctactgataaagacatacccaagactgggcaattcacaaaagaaagaggtttaattagatttacagttccacatggctggggaagcctcacaatcatggcagaagtcaaggaagagcaagtcatgtcttacatagatggcagcaggcaaagagagagagcttgtgcagggaactcctctttttaaaaccatcagatctcataatacttattcactatcacaagaacagcatgggaaagtcttgcccccatgattcaattactcccaccaggtccctcccacaacatgcaggaattcaagatgagatttgtgtggggacacagccaaaccatatcaagtacctagattcatgtttgattaaacaaccagggagcagaaatcttcaggagtggggggcatctttagaattctgcccaccaaggctgggcgcggtggctcacacctgtaatcccagcactttgggaggccaaggtgggtggatcatgaggtcaagagatcgagaccaccctggccatggtgaaaccccatttctactaaaaatacaaaaattagccaggtatggtggtgggcacctgtagtcccagctactcaggaggctgaggtaggagaatcacttgaacccaggaagcggaggttgcagtgagccaagattgcgccgctgcactccagcctgggagacagagcaagactgtctcaaaaaaaaagaattctgcccatcatagtaggctgtcctacagagacataacccaggaattaggtgaatggctaacctaaattagcactgtgatgtgttttctgacttggtccttatagctcctctgcttagatgtggaactaatccatgaatgcaagggtttgtctagagttttaagtgggagttaaatatccaaagtacaggagatattatgggtgcctcatccatgtccccttggcatttatctttcttggataacccaactctattagtttttatatctcacttgttcctatactctgtgaactgatgtcccataaatagacatttcattttgccagtcttcttgaacaataattacgattattaatctagcagttatcattaattggccacttcacattagacacagcacttaggacttaagaataccatgtcatttgatcatcataatatggtcaggaattaagtattgctatccaaattttacaaagaaggcactgagggttagagtttaaataacttgcttaagatgtcatagcctgtaagtgacaaaactaggactcaaatacaggtccatctgactccaaagtctatgttcttggctaccacactgcctctcctacaagtgacctgtggttttactactatattcacactctactaactttaccatctcccatgagtctgtctagaggagggcacacacagcacagaaaacacatgaatgcaaaataaggaagggcctacttactacacagagccattctaatacctgatgtttgctctaatccagttttactattaattagttgctggtgcccaagtttttactgagaaatggggataattttggaagtcataatgatgccttcttctcatagggtattttatttgttgttgtatctccaggccccaacacagcctggcttttagtaaatgatcaaaaatacctgttgaatgaataaatggagtcacctgaaacatgttaaacatttgttcatgtgtcctaatcgtggatttcaggatagtaagcatcctaaaaggaaagcatgcacactgttcttgctacattaatttctcacaatataaaaaaagaaaagcatctgaaaaaagctgccagccgctgtgtctcctaatatcaaactgagcacagatatggagaagctaagggagagggatgatgggccatgcctctaacctcatcatggcaaaagtcctgggggtcagacccgaggagagcaggaagtgtcttttgagggatacatttccacagtggaaataatgagacttaaataaatattatatacacagttcaactgtttttatgtgtaaaggtagtaggttttcacagtaaggaagcacttctttttttttttgtttgagacagagtctcgctctgtctcccagcctggagtacagtggtgctatctcggctcactgcaatctctgcctcctggattcaagtgattctcctgcctcagcctcccgagtagctgggacaacaggtgtgtgccattacacctggctaatttttgtatttttagcagagatgcggtttcaccatgttggccaggctgatctcgaactcctgacctcaggtgttctgcccgcctctgcctcccaatgtgctgggattacaggcatgagccactgcactcaccaagcacttctactgatagcatttacaaacccttcttagaatatttaaaaattctaagagaagagtaaattgagccttcccaactaatactaggaggttataaccttcataccaaaactggacaatgcttgcacaaaagaaggaagccaatgaggccacctagaaggaagactgggcattgggcccagtgagtcctggaaacctcatctgtgccagccaccccggcatggcctgtatgagtggatgagggtgacttgtccacagacaatagccatctagctgtgataaaggagtcaaggtagtcagctgcatctctttcacctgtttgccaatgttacacaggttgaaaagctaaggtttatgtaaagcaagcatcaaagatgatgaaatgatcaacctgacaatgagtactatgctgcattgtccagaaaggaactgtggaagattttgggctgaatttcaaaacagaatttcctcactctctggatgttggcttacttggcctttgatgttcagaggtggtgcctttgtgttgttgaacaatgttgattttggagagaaaacagagttgaaaaacccacaagtcattccctggggagtattaccggaatacagaggataatttcagcaagccagcaaggcctcatctctgcttctaatagataggaagaaaggaagagaggaacaatacttttttaagaagctcagctttatcgccttatctcatagaaagatgcctccagtctgtctggctaaaggtaattggcatgggaaagtctttatctgtgattctaacaagtggaatgtttcccttcattaagagagccttgtctggcttggggaaatgaaacactttctccgatatgagtgggctgtaacccctgctactaaatactcagaagaaataaggcggttgtggagcagtcaggaatgagtcacttgcctccctggaatattcagaaaactgaatcaaaagtacattcttctgggttttcttagtctaatagactaagggtctctactttgttaaatttctgggaaacagcatagaatgggagaaaaaactggtcactgtagtcatgcaaatctgcaaaacaaacaaaaaagtctgggtattgctgctaactagctatgtgaccttaagcaaggtattaactctctctgaatttcaggttcttcatctgttaaatagcatatctgtaaaatgggaattattttcatatcataatgctgtagctttaaaaaataaaataaaatggatgagataatcagaattaaagagcctgggatatatagttaatatatagcagcatgtaaagatcctgttagaaatgctaattttacagttaaccatttggagatgatccgccaaagctgctagtgtagaggcaactgagaatttgcctgtccttcagaatatgaataaataactgtcaatgatgtctcaagcctagaaaaacctatccatctggatgggtgggaaatttctaggctagtattgagaagcccatttcttgggaaataggtcctggactgagtgaaggaaaagaaacagtaaaacccatggtaaagcagcaaggctctctagaggctctggagaggatgaattgaattctagaagatgaagtagggaagacgctttaccttcttgtgaaatggattcaaagattcaaagaccttcgggaatctccaattgtataaatggcaccatagctgtatgttccatggaacactacttcccagagatgcccagtgaaaaaagaatgccacagtcaaataagtttggaaacactccattatgtggccacctccttgaagactctaatgcacattagcatgttaaacagtcttgagaagtcctgcagagcagaaattgcttcacatctgctaagccggcagtttcccaatatacttgattatggatagttttttccttacaacaccattctctgatatgcttccaatgacatgaaataaatatatatgcatgaggttcttcattagggcatactttttaatagaaaatattgagaataatctaaatataaatgcacagcatttaccttttctgcataaactatatacaggcataccttggagatactatgggtttggttcccacaatatctccaaaaccacattcggttttatgaccactgccataaaaccagccacatgaattttttggtttcccaatgtatatcaaagttacatttttactataccatagtctattatatatacaatagcattatatctaaaaaacaacgtaaacaccttaatttaaggctgtggctggtttgattttctacccagaccactaaaactttcttcatatcagcaataaggctgtttcactttcttactattttttgtgatagcacttttcctttccttcaagaatttttcctttctattcacaatttgtttgatacaagaggactagattttagcttatctcagtttaaggtgtttacattgttagctaaaaatgctaatgatcatctgagacttcagcaagtcataatcttttgctggtggaaggtcttgcctcagtgttgatgtctgctgactgggtggctttggcaatttcttaaagtaagacaacaatcaagtttgacatatcaattgacccttcctgtcataaatgattttttttttctctgtagcctgcaatgctctttgatagcattttacccacagtagaattttcaaaattggagtcaatcctttcaaactctggtgctgttttatcaactaagtttatggagtattagaaatcccttgttgtcatttcaacaatgttcacaccatcttccccaggagtatattctacctcaagaaaccactttctttgctcatctataagaagcagctcctcatccactaaagttttatcctgagattgcaacaattcagttacatcttcaggctctacttctaattctagttctcttgctgtttctatctcatttgtgcttactttctccgctgaagtcttgaaccccttaaagtcactcatgagggttggaatcaacttcttacaaactcctgttgatgttgatattttgacctgctcccatgattcatgggtattcttaatggcatctagaatggtgaacgttttcagaaggttttcagttggctttgcccggatccatcagacgaatccctatctatggaagctatagatttataaaatgtatttctttttttgtgggggcatagcgtctcaccctgtcacccaacctggaatgcagtggcacagtcataactcactgaagactcaaactcctgggctcaagtgattcttccaccttggcctcccaaaacactggattacaagcttgagccactgtgtctagcccaaaatgtatatcataactaatgaggcttgaaagtcaaagtgactccttgatccatgggctacagaatggacgctgggttaccagacatgaaaacaatactcatctcctcatacatctccttcagagctcctgggtgagcaggcccattgtcaaatgagcagtagtatcttgaaagaaattttttttctgagcagtagatctccacagtggacttaaaatagtcagtaaactatgctgtaaacagaagtgctgtcatccaagctctgtttttccactgatagggcaaaagcagagtagatttggcataattctctagggccttaggatttttggaatggcaaattgagcattggcttcaacttttttttttttttttttttttgagacagagtcttggtctgtcacccaggctggagtgcagtggtgcaatctcggcccactgcaagctctgcctcctaggttcacaccattctcctgcctctgcctcctgagtagctgggactacaggcacccgccaccatgcccggctaattttttgtattttagtacagacggggtttcgccatgttagccaggatggtctcgatctcctgacctcgtgatccacccgcctcggcctcccaaagtgctgggattacaggcgtgagccacagcgcccagcctgtcttcaacttaaagtcgccagctgtgttagcctctaataagagagtctgcctgtcctttcaagctttgaagccaggcatcattctcttctctagctatgaaaatcttagatagcatcttctcccaataggaagccattttttatgccctaaaaatctgtcgtttggtgtagccaccttcatcattgatcttacctagatccgctggataacttaccacagtgtctacatcattacttctgcttcaccttgcacttttatgttatggggatggctcctttcctctaacctcataaactaacctccactagcctcacattcttcttttacagcttcctcgcctctctcagagttcacagaattgaagaatgttgggccttggattacactttggtttaagggaatgctgtggctggtttgattttctatccagaacactaaaactttcttcatatcagcaataagactgtttcactttcttactattttttgtgatagcacttttcctttccttcaagaatttttcctttctattcacaatttgaccgtttgatatgagaggcctagattttagccaatctcagtttacaccatgcctttttcactaagcttcatcattttagctttttatttaaagtaagatgtgtgacccttcctttcatttgaacacttacatgatgatgcctggcttcaaagcttgaaaggacaggcagactctcttattaggggctaacacagctggcgacttttaagttgaagccaatgctcaatttgccattagaagccattgtagggttaattaatttgcctaattttaatattatggtgtctcagggaataaggaggcctgagtagagggagggagatggggaaacagccagtcatcagagcacacacaacatttatcaattaagtttatcaccttgagggcacaggtcatgatacttcaaaacaattacaataataaaataaaaaatcattgatcgcagatcaccataacagatataatgataatgaaaaatttgaagtattgtgagaattaccaaaacgtgacacacagacacaaagtgagcacatgtcattggaaaagtggtgctgatagacttacttcatgcagggttgccacaaatactcaatctgtaaaaaattcaattatctacatagtaccataaaaacaaggtatacctgtttatataatcaagaccaacagaaccctagagaaaatagctcactccctagctcggagacattctaaccaacatacacttacctttctttttgctgtgtacagaattcaaatccctgtctcagcaaaattgcaaagtatcaaatgtcatgtccatctaatactcaaaactgcaaatgttaagtcttgtaagcccagagaccactgtatatacaagtgttgctataagcattagttcttctccaaagaaaatagtccacttggtagaaacaaacaaaaagaaaaaaaaagaaagaaaaaacattttttacaagaagattcagtctcttacctacataagcaaaaatatgagatgttctcttatcatttttccatctatcttataatctttggtgctgacttagacactcattttcctttttgtacgtgaccatgtaaaagttcaagtcaagaaaaacttgttttgacatttgttttgctgagtgatgggtccctaaaagaaatttggctttgcttttgaaaagttcagcatgatattgtgtgaatttttcatggctaatgatttttagaacagttgtgatgtgtttaggtgttttaagaatatgaagcattcagtggtttaagttggttgttataaaatgaaagaatatgaaggaaagccttcttgtcttagaacacactgattcacaaataagcagcttctctcaaaatgttgtaattacaaaaattccaaggcaaatataataaactccttgtcggtgctatgtctagaaacttaacagccccaaagaaagtcctgacaaggcaaaaaatatatatatatatacaaattgtggaagcagggtgttgaaagaagaataaagactatataaggacaaactgtttaaaagggagggtatccttgaaagcttgacacttgactcttttgacgaggctgagggaaaacactcagtttcatagattgctggtacggatgtaaaatagtgacatccctatagagaggaatttggcaatatctagcaaaagtgcttatgcatttattctttgacctagtaatcccgcttctaggattagtggtgaagatacacctcaacaataaaaatatatatacattaggttattagttatggtttaatttttaatagcaaaatatttaaaacaacctacatgaacaaataggagacttactgaataaactatggtatatctgtacaataaagtgcaattcacttatgttgttaatttgttccaaaaatccagagccaaagagtatttgttatgctctctttagtataagaaaggggaaataagatatgtgtgcatctgtttatttttgtgaaaataagtacagaaaggataagtaagaaactagtaaaactagttatctcctagtgttagtagaaatagaatgaaagtgaattaggcttctttgagtatatgtttatatatagttttgacttttgaattatgtttatgtttacatagtcaaaaatataaattaatcaacagaaataacaaaaaaagaagaaatcacaagctttaaaatttaatacaaacagaaataattgaatctaacagtatatcaaagtgataacgtaaactcagaagaaaaaaacataatccaacataccagtggaacacaatattctaactgtatacattcagtggttatagtctaaggacaagaaaaattgcaaaaatatcttgaactttagcttgtaggatttttattggtagcaatactaatgtactaattctgaaattaatgttcgtgtattatagaattgagtaaatgaataaatatgttgatgttattgggaactaaaattatcattctgggagtagagaaatataaatatggacttggcaaatgaaacaaagacctgcagagagataaccatataaactcattattttaaaaattataagtgtcctagctctgttactgaaaaggcctagattcaatcttatcttgatagacaggagggcacccctttctcagaacatggtttccaaatgccattctccattaaaaggaacaaggtcttcttggagaaaagactgattctaggtctggattaggtaaagtacaacgttagtctggaatttcttgctgaatcagaagtaagaaagtgctcaaaaacatgggaacatgtcacaaacacacgtgaggcaacttgaatcctcactggccatatttaggacaatcgagcatcaaaaaaaaaaaaaatgttgagaataatggattctaacacttaaaacaaaaaataatccatagcccacagaaggggaagagagggggagctcttatttacagatgaatatcaaatagcaaagacagaagaaatgacagaattagagaaacatcattttgcaaaacaccactgtaataatcaattcaggcaagtattattaatggatgtattactattgcgtaaaaccagttggggaacaggatattcatacagtctgaaggtgtcaccctaaacataacttattacaagtggaaaatggtgcctttacaatgaagaaatctagcagaaaccatcttaatctagtgatcaaacttagtatcaccaataatggatcatactgagtcatgtgtctcctaatatgatgcaccaggaaggatgcaacgtcatgaacgttgtattcttttgtattcaacagaccacccagggtaaaggcagctttctcacttactaatcagaattgttggttttaattcattttggattttaagatttcttactttcttgtcagctcagaaatttatttaagatgatttttatcttttattcaatactttagcttggagaaccattcagagtttctaactcattgtattgccaaaaatagaaaacagcatggtttcttttgaaaatgtctaactttaaagttacttgtgtgtgtcactcagattcacatagcttttttgcctagtaatgtagtatcatgtggcaaggctataaaaatgtttacaatcttttatttaatatgactcttgagagtttattctaaggaaataattgaatagtaacaaaacactattaacacaaagcatagcaatttgatttgggcaaccaaacactggaaacaacctaaatgtccattacaggaatcatttatgaagcaaacactaaaatatttattgtgaagattatgagaacatagaagacagttatgagagtaaatttgaaaacctgaacacaaaacttacatatactccaattgtaacttataaaaaatacgtgcatataaggataaaacagtacaaacaaaaaaatagttgcgttagattggtagaattatggctccttttgctgtcttaattttttccttttacattttgatacattattttaattttaattttaaaattcaaaagaatttgccactcatctttgccacttcaaggaaaaaagaaatgtgttcgattattctgttcttagtatagttttggcaatttcctcacgtgtaaaaagagaatactattaataatttcagtatctataagacaatataaaattaaagaatctagcccagtaactggtacatggaacgtaattaataaatcattatggactttttttctcacacccaagtagggaggaatcagtggtcccctagaggcccagtgtagaggtggcagcaccaatccctaggggagaagatcttggtgatgataattcctgagcagacagttagctgagaattcaagagcagaaaagtaagaaagaaacaacttcttgctaacacctttccacccacgtttccctgttctgttgtactctgcttaccctttcatggatggaggcagaggaaagagaaccaagtttgctcttagtcattcactatgttgtttaatctgccttccatctttcttatcagttcaaattagaatgtagacctgaatttaaatccccgttctgtcagttataatgtgaccctagacaaaacacattctctgaacctcagagaacattcttcatttgtagaatgggaagattaatctatattccacttggatggcaagtcttttataaactttataacctaaacatgtgtgagttgctagtatcattatgttggtaaagttattctgagatatgataacagaactgttttgtctaactccactagcatggttcaggtttagagagtgtggaattaaaaggctttatcctcaaatatgacttaaatccgatttttctcatccactttcctccacaaacaaatcctcaggaaatgacaaactttacatggttaaacatcagttttgtttagtctttgacatccacatggttaaatcatacatttgaaaactgcttatatttgtgttgtctatgtctaaattgaaaagacttattgaggaatagaagactacacatttttcagcaaacactgcacgttttgcagaatttccccaggcaccagtctccaggaatttattggctactaacaatactaagatatggatgaatgaggaaatcaaaatggagatcttgcaagttttgtgagaatgggtgaatggtccaaatgaagagataagttgtgaaatattagtacaagtaaaaattatttacaatgaaagacattttgtcaatagctatgagaattttaccattgacccagaaattccatttctttcttcagaaatacccacgtaggtatacatataaaaagttattcattacagtatcgtttttcataggaaaaagttttaaaaatcagaagctatctaaactatggtatatctaggtcatagaaatcaaatgactaaaaatgttaatataagcatatgtttttaaattaacttggcttgggtcttcagcaaaattggcttcttaacattgcactccagagttagacttacccactcagtcacttatcatgcaggagcagactcctaataccacatatcatagagcagagtaggacacaggttctctgcaggcaggcaaatcccaaagagaagggaggaaagggctgagacactgcatggtcaatttcttctgaactctgcaatgtacggaggtggacagtgtccacaaagattgctcccctggacccaccatcataataacacaacggctttgttttgtttttgtttttgttttttgacacggagttttgctcttgttgtccaggctggagtgcaatggtgtgatctcgactcaccacaacctccacttcctgggttcaagtgattctcctgcctcagcctcctgagtggatgggattacaggcatgcaccaccatgcccagctaattttgtatttttagtagagacgaggtttctccacgttggccaggctggtctcaaactcttaacctcaggtgatccacccgtcttggcctcccaaagtgctgcgattacaggtgtgagccaccgcgcccagcccacaatggccttttgtttacatctctagtgcagcactcatttcatgttctttcaagaagaatacatatttcatctttttattttatacagcaattagcacagtgcctggcataaggaaaatgatcattaaaagctgggtgaaaaacctaataaagctactgaggataggaactgcagaccagcatggaaagaaaactatgagccagatattgacatcatcctgaaaggcagaagatttagtataggcaagaagtatgcttttggaatatagaaaatctggattatgataagaaaagaatcatatttgtcttatcttacctactcacttctcagttccacatgtttctgaggctgtttgtccttactttcttttctgttttatccactctttctgttctttagattggatcattcctattgagctgacatcaagttaactgaccttttattttgtccaaactgctgttaaatgcatccagtgaatttttaactttatatagtatatcttttagtcctagaatttccacatgagttttttaagtttccatttctctgctgagatctcctatttgttcattcattatgaccatatttttctctacattattgagcataattataacagctcttctaaaattcttgtctgcacattctaacacctgaattattctggggtcagtctctgttacattgccttattacaaaaacagtataagtcacattgccttgtttcttaatatgcaaaatgatttttgattgcagactagacattttgaattaaacattatagagattctggattctcgagagagtattgacttgttttttccatcaggcaggtaacttgactggactcaaactccaaactctaggtcctctgtaatgggcaactgcagtaatctttgtttagttctttaagacttattggccaggcacgggggctcatgcctgcaatcccagcactgtgggaggccaaggtgggaggatcacctgaggtcaggagttcgagaccagcctggcccacatggtgaaaccctgcctctactaaaaatacaaaaattagccgggtgtggtggtgggcgcctgtagtcccagctactcagaaggctaaggcagaagaatcacttgaacctggaaggcagaggttgcagtgagccgagattgtgccactatactccagcctgggtgacaaaagcgagactccctctcaaaaaaaaatttattggcactgcttggcatctgctatgaatacatgaagttcatgggtcagctatagatctgggcacgttatacacagaatttgggtctccctttctctggatttctccttttctggatttcttttctcattttccagcagctgtggttgccctaaactcggtcctctgtttctttacggcagtaagatttgggaacttttaggttttacctgcctctcagacaaaataaaaaataattttcatcttgatgctactcctttcttccagatgtagacacctctctaatttccagttgctttttattgctctccagagtctaaagattatcattgttttctgtgggagagttggtctgataaaaactactcccccaaaactggaagctggaagcttgtaattatgaatagactttgagtagtattcttctttggaaaaggattttaactactccctatgtacttctttatttcctgtttttctcatccgtaatctttttattttcatacttcctaagtcagacaattttcctacttgaagattcagtgactgctatcaaatgacccccatattactaaatacaatatccccaactgcatttataaaaagaaaatttactgtttattagtaaacaatgttgtagaatagtaaaatattgctgggctttggagccagataatcaaggttagaatcccagattctaacttactagctggtgtattagtcctttctcatgctgctaataaagacataccccagactgggagactgggtaatttatgaagaaaagaggtttaattgactcacagttcagcatggctggggaggccttaggaaacttacagtcatggtggcagcaaggagaagttccaagcaaagagggaaaagccccttataaaaccatctgatcttatgagaactcactcactatcacgagaacagcatgagggtaactgccctcacgtttaattaccttccaccagttcccccccatgacacatggggattatgaaagctataattcaagatgagatttgggtggagaaatagccaaaccatataattccacccctggcccctctcaaatctcatgtcctcacatttcaaaactcaatcatgccctcccaactgtcccccaaggtcttaactcattccagcattaagtcaaaaatccaagttcaaagtctcatctgagacaaggcaagtcccttctgcctatgagcctataaaatcaaaagcatgttagttacttcctagatacagtgggggtacaggcgttgggtaaatacactgattccaaatgggagaaattgccaaaacaaaagagttacagaccccatgcaagtccaaaacccaatagggcagtcattaacattaaagttccaaaatgatctcctttgacttcatgtctcacatccaggtcacactgatgcaagaggtgggcttccaatggccttgggcagctctgcccctgtggctttgcagggtatagcctgcttcctgtttgctttttcacaggctgacattgagtgtctgtggcttttccatgagtatggtgcaagctgttggtggatttaccattctggggtctgggccaggtgcagtggctcatgcctgtaatcccagcactttgggaggctgaggtgggggatcacaaggtcaggagatcgagaccatcctggctaacacggtaaaacccagtctctgcttaaaaaatacaaaaaattagccaggcgtggtggtgggtgcctgtagtcccagatacttgggaggctgaggcaggagaatggcgtgaacccaggaggtggagcttgcagcgagctgagattgtgccactgcactccagcctgggcgacagagcaagactccatcaaaaaaaaaaacaaaaaaaccattctggggtctggagaatggtagcccttacagcaccaccaggcagtgccccagtggggactctgtgtgggggctctgaccccacatttcccttctgcacggccctagtagaggttctccatgagggttctacccctgcagcaaacttctgcctggacatccaggcatttccatacatcctcggaaatctaagccgcggaggttcccaaacttcaattcttgactcctgtgcacccacaggctcaataccacatgtaagccaccaatgcttggtcagggcttgaaccctctgaagcaatggcctgagctgtacgttgacaccttttagcctagacatctaggacacagggcaccatgacccgaagcttcataaagtgggagggccttgggactagctgaggaaaccatttttccatcctaggcctccaggcctgtgatgggaagggcagccatgaaggtgcctgacatgccctggagacgttttccccattgtcttggtaactaacattcagctccgtgtgcagcaccaacttacttatgcaaatttctgtcactggtttgaatttctccccagaaaacaggatttttcttttctattgcatcatcatgctgcaaattttcaaacttttatgctatgcttcctgttgaagactttgcggcttagaaatttcttcccccagatacccaaaattatctctctcaagttcaaagttccacagatatctaggggacaaaatgttgccagtctctttgcatagcaagagtgacctttactccagttcccaacaagtttctcatctccatatgagaccatctcagcttggacttagttgtccatgttactatcaacattttggtcaaagccattcaacaagtctctatgaagtttcaaacttccccatgttttcctgtcttctaatagccctccaaatttttccaacctctgtctgttacccagttctaaagtcacttctacatttttgggtatctttacagcagtggcactccccatggtactaatttactgtattagtctgttctcatgctgctaataaagacttactcgagactgggtaatttataaagaacagaggttcaactggctcacagttcagcatggctgggaggcctcaggaaacttacaaacatggtggcagcaaagagaagttccaagcaaagagggaaaagccccttataaaaccatcagatcttgtgagaattcactatcatgaaaatagcatgagggtaactgcccccatgattaatttacctcccacagggtccctcccatgacaggtggggattatgggaactacaattcaagatgagatttgggtggggacacagccataccatgccagctagagagccttaagaaagtcacctaatctccacaaataaaaggtttcctatttgttcaacaaaaataatgacaccccttttatgggatttctgtgaggacaaatgataactaacatagccttgcatagtgtctggcacaaaatagctactcaaaaaataatagaaacaacatttaaaaaatgtagactttattttttagagttttatgtacaaagcaaaattgagcagaatgtacagagagtttccgtatagcactccctacccccaagcacagatagcctcccccagtatcagcatcccgcaccagagtggtacatttattataactgatgaatctatattgacgtgtcattttcatccaaaatccatagtttatattagggatgcctcttggtgttgtaccttctatgggttttgacaaatgtataatgacatgtattcaccattacagtatcataaagaatagtttcactgtcctaaaaatctttgatcttcttcctattcatcactccctccccattaatccctgacaactactgctaattttcctgtctccattgttttgtcttttcctgaatgtcatatagtttaaatatacagtatgtaggattttcaaactggtttatttcacttagtaatatgcatttgatgttcttccatatcttttcaaagcttcatagttcaatatttatagaattgaataatattccattgtctggatgtactacagtttatgtattcattcacctatcaaagaacaccttggttgcttccaagtttcaacaatcatgagtaaagctgctataaacatctatgtacatgtttttttgtgaattgaacattttcagcttttttagctccattcctaggagtgcaattgctggattgtatgataagggtatgtttagtgttgtaagaaactgccacgctcttcctaactggatgtactgttttgcattctcaccagcaatgaaagagttcctgttgctccacatactcaccagcatttggtgtcgtcaatgttttgagcaatagcattttgatctaacttttcctaggtattctttttgaaggaaataatatgacagataatagagaaaggatatacgaggacagttctgtcctttatttatagtccatcatttaatgaaggactctgtccacacttggtatttttaactctgatcctcctctcccatgaactctgacaatctcctaaatccctgttgctggcacacatggttgtgtatcaggccccctgtggtctgtctgaagcatggctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcctggctaattttttgtatttttagtagaggcggggtttcactgtgttagccaggatggtctcgatctcctgaccttgtgatccgcccgcctctgcctcccaaagtgctgggattacaggcgtgagccaccgcgcccggcctttttttttttttttttttttttttgagatggagtctgtcactctgtcacccaggctggtgcagtgatgcaatcttggctcactacaacctccatctttcaggttcaagtgattctgccacctcagcctcccaagtacctgggattacaggtgcccgccaccacacccagctatttttttgtatttttagtagagacgtagtttcaccatgttggccaggctggtctcattcctgaccttgagtgatccacctgccttggcctcccaaagtgctgggattacaggcatgggtcatcacatgtggcctgaagcatgactgttgctttaatcatatgaaatactgctctgtattgttatctatttgaaatgccacacctcctgagctaaattgcaagcttttatggagcacaaaccatatttatatatattagcatgataccatgacacatatcaaaagctgttatatattgttacgtgaattgattctttctcagttaagaggacctctgtagtagcactttcataccgttaatttttcattttgtgcccagcccctactctgtgaaaaatgaaatgaatcctgttatcatttccctcccaggccttttctccttgtggacaatgtgtggctcaagagaaaattcagtcagtaaatttgttcagtgcacaaactctttatcacctctcactgttctcaagtgagatagaacagaacatccatccagtgtcttacaaattgtctggtatatagtaggcactcaataaatgttttttgaataaatgcatacatgaatcctattcctatatatagtatggtagacagatcattgatacccaaagatgcccaaatgctgatccccagaacttgtgaatatgttacatttcatgtcaaaagggactttgctaatgtgattaaggattcagacccttggattgtaagattatcccggattaaccagggccaatctaatcacatgagaccttaaaaaagcagaaaacatttcccagctgggttagagagagatgagacagagtaaaaaggaaagagattcagggcatgaaaatgactctacccactgttgctggctttgaagatagaggaactaggccacaaaacaaggagtatgagtggccttaagaaataggaaaaagccctcatctgacagccagctagaaagcagtcctctgaccacaagaaattggattctgccaaccactcaaatgagcaaggaaatggattctcccctagaacctccagaaaggaacacagctctgtaatgccttgattttagccaggtgagacctgtttcagacttttgacctatggaaatataagataataaagttttattgtatgctgctaaatttgcggtagtttattactgaagcaatggaaagccaatacagacagaatatacagagagaaagagaatgagttctttcctgataatttgtaaatatttgggtcttcactggacaagcttcacagaggattcactggttccctagcaaaccagcatgtccagtcctgcagcctccctttcttaggcccagcatatgtcagctgtgtgcatagaaaaatcaaagcaggaccctgagtagttggaaagaaaagatggttggaaatgggttgcacttcaagtgaggaaacaagaggtaggagaccggcatctctttctcatatgtcccaggctgactcttgtgagttgttttcccttggaggctatcgatgacagtcacagtaacctgatggaacctggatcatgatgaaagaagtaagtgtcaatggctccgacttccaaggactctgatgtcccacagcactagctaaacaaagccagttggaaatgagcttaaatggggaatttcctgaatatattccctattgttaggaagccaggttggcttccttgcctacaattatgccaagcagtcacactatagagtccctagggacatgatattaagtgattcttttaacacaaacaacttaataatcatttatactaatagcaaaacggccaacggctgatattccacttgaagtagaattggctatccaactggaagagaagacaggaagacgtgatctccagggagccactaaaaggattggcacctgcctctggattccccttttccttatattacctctcagcactggcaggcctttatttcaggatacagtttcacaagtattatgtcacgtctctgagaattatgttggtagatatttgctcctctggccagaaagacctagtttggagtctggagtcatgaaggtgacatacatgtagctagtgacataagtgtagctagtaaaaatagtgagtaatggccctgaaattctattgaatgcccaaagtgctgaccaggaacaagcatgctctagcttatctcacaaggaacttgacaattttcttcaaaaatcctagtagctaagatttcttagtaacaaagccactaaggcacaattatgattaacttgacccttaggtgacttttaaggactattctataaaatattacaactaatagtggatccaagccagcacactctgctatataagattaattgacagtgtccacactggtaaaataagttgtttcataaatacattagaattcatttgcactttctacacagccccaagtccagaactttccccagaataggtctatgttttgcaatctgctactccatacagagatttgagttcacttggcaatttagtgctgcttatatgtgaccagttagtctgttttacttatctatgccttaaacattactatacttactaactccaagatgcctggtctcaacttgacaaaaataccccaagttgggaaatccttatgtgaatatgtagatagtcacaattgctggttgatgatgatctgtcttttcctgtatttgagaaaatggagataaaatggaccaatccaaataatggattaaacatgggaataggtgagagagagagaggaatacatggtggctctcagtgtctggcttaggcagtaaacactttcgttaataaagacggaaaataaaaaaggaataattggtgtctaggggaaaataatgagctcaagttttaacactctgagttcccggatgtgagacatccaggcgcatttatccaagaggcagttggaagcaacgttccggagcttaggagagaggcatgaccaaaagctggtgggactgtgaaaaggtatggccattctggaaaactgtttggcagtttcttagaaaattaaacatgtactaacaacccagcaattgtactcttgagcatttgtcccagataaatgaaaaaaaaaaaaagcattttttttacacaaaaacatatacatgaaagttcatagaagtgttattcataaaaaactggaaaaaactgagatgtctttattgagtgaatgcttaggcaaacggtggtctatccatacaatggaattatgcttagcaataaagagaaaagaactattgatacatgcaataacacagatgaatctcaaaggaattaatgctgagtgggaaaaaaagcacatctcaaaatggtatatactgtactattttatttacttaacattttaaaaatagcaaaatcatagagatggagaacagattaatgggtactgtgttttgggatggggagtgagaaaagggtaaggtgtaaatataaaggggtagcacaaaagagccttgtggttgaaggattctatgtcttggttgtagtcgtgattgcaggaatctacatgtgataaaattgtatgggtctacatacgcatacacacaagagcatataaaactggtgacatgtgaagaagctccgcacattgtgccaacatcagtatcctagtttcaatatcagactacagttatacaaaacattgtcattgagggaaactgggtaaagggaacacaggacatttggcatatatttttgcaatttcctgtgaatccgtaattatttaaaaataacagatatactacatatcaaaaatttaatgtcataaagttgatgagtttacctagtggatagctttgttaatatctgctataagactactgaaaatgacagttatgcaagtataagctcagagaactttcctcccccttcgtaaatgaaatgagcaaaagaaatgaaacaggaaaggcaagcagtactgaaaacagggaagggctcttccccatataactatatctgcgacttcaacagctattcatccagaaacacagcctcttgcgctaagaggaaactttggataacaatatgttttcactctccaagagagaaaatggatagattaatttttaagaaaaaaaaaaaaacctcaccaatttcatgctgtggcttgcacctttaatcccagctacctacaaggctgaggtgagaggcttacttgagcccaggagttcaaggctgcaatgagctatgattgattgtgctatcgcactccaacctggagtactaagctaagagctaagaacacagctgagagcggagaagaaacaaacaaatctgaccaataacccccactcccctcattttactggagtgagctgagactgctggcaaacatggcctttgacctagcctgaactgtagcaaaagtcatcagatatttttccaccaatcaacagacagaagtggggagaaaacaatcgtagttcataactacaacaagcagataaacgaaggccatggtgagggatggaagacattgtgatatatcaaaggcaggctcatttaaaactcaacccaaattccaaacaaaatatataattgaatatgtattaatgccaaaggagcttgagtgagctttagcacaaaccccgccctccagcccccacccaaaaaaatcactctgttctctccccattctttgataggcatacttgctgttttctcacagccaaggtacagaggggacttagaggaactagaactctaatacactgctagcaggaatgtaaaatgaagcatctacttcagaaaaccattttatcagtttctagaaagttaaacatagacccaccatgcagcccagccactctactcctaagtatttacacaagagaaatgaaaacgtgtccccacacagttgtatttaaaggtgatggttagccttgtgtgtcaacttggctaggctataatacccagttactgaatcaaatagtaatctaggtgcatctgtgaaggtattttgtagatgtggttaacagctacaatctgttgacttcaagtaaaggagattgctcttgatagtatgggtgggcttcatccaatcaattgaaggccttaagagcaaaaagtaaggtttcccggagagaaagaaattctgcctcaagactgcagcctcaactcctgcctgagtttccagtcagccagccagcctaaagatttgctaggcattataatcacatcagctaatttcttaaaataaacctctttatatatattgatacaatgaatggttatagcagccttatttgtaatagccacaaactggaaacaacctaaatgtccttcaataagtgaatacataaacaaattgtggtatatccacaatttttacgcagcagtaaaaaggaataaatggttgaataaggaataaacacataacaaggatgaaccttaaaaccgtaaggctgaatggaaaaagtcagacaaaactaatacatactgaataattccatttatattgaagttctagaaaatgaggactaacctatagtaacaaaaagcagaaaaattttgcccactggtgatggagggggcgcaggtattgtagagtatctgagaaaggacaactggataaaagggggcacaagaaaacttttgagggtgattgatatgttcattatcttgtggcatggtttcataggtgcatacatatgtcaaaacatcaagttatacacttttaaaatgttcagtttactgtatatctattatacttcagtagagaggaaggaagaaagtgggcagggtgggggagaggaaaggaaacgagggaggaaaggccctaataggaaggattttggagtttagattttaaaatgataaaggatgtttgacactctaggcatatgacgaatataggattatgagtccacaaaaaccaccaggaagtcatgtatgtttatacttttaagtgaaggatcagtggattatcaactccctaatgctttgcctctctatgactggctgctgtccttctcatcccaatactccttccaaagccccttgcttaaatgtaagccttctttcctcctttcaacacatcctgcattccgtgacaaaataagttttccttaaacagaatgtacagcatattatttgtacaattaaaaatttttggccaggtgtgatgactcatgcctgtaatcccagcaatttgggaggccgagatgtgtggattacctgaggtcaggagttcgagaccagcctggccaacatggtgaaaccctgtctctactaaaaatacaaaaattagctgagtgtagtgtggcaggtacctgtaatcccagctactcaggaagctgaggcaggagaatcgcttgaacctgggaggtggaggttgctgtgagcagagatcagactattgcattctaggctaggagacagagtgagactcggtccccaaaaaaaaacacatttttttttaatgtttcctccttgcctgtaggaaaaaggctctgactccttagcctgggcatcagagctctatctaaatggactttaacctgattttgtggcactaattccattgcagtacttgtccgctcactggcctgtgcctctctgccactatttttggaataatgtcctctctccatcttgtttactcaactatatccaacctctaaggctgtgctcctacaaagcctcccctggctacttcagcccacagagatatttaactgctctgcagttcaggacattcttctgactctttaaatcacatttacttatatatgatcttgtgatattttttgttgacgtgtttactttaattttcttccataacctattcattcaacaaactcaacaattatttattaaatgccaagttagaaaaatattattgattttatatagattatagatatgtttgaaattttatttggcaatctgcaagtagaaaaataattataatgtggtatatctgtgatagaagtattagtgcagagaccatggggaacataatccagcctggaagttcaggagagatacgtggaagaaaggacgtcagagcctttttcctacaggcatggaagaaacattaaaaaaaatttttttttttgagatggagtctcactctgtctcccagcctagactgtggtggtgcgatctctgctcactgcaacctctgtctcccgggttcaagtgattctcctgcctcagcttcccaagtagctgggattacaggtacctgccacacatggatgataaatatgatcatattttcttgttcttttcctcctcagttgtcttccctgaagaaaggaatgccttttatagatgacaaactcccattctcaagaacaaggatttttgaccaatttaatttaatcagatgtctggctttgacctagaaacacagtcacgaaacttggtgattagagaccaattcccaaacatgagcatttcttaggaaacacagtaaagatctgagagacccaagagcagaagggcgagaaaccaaaagccatcagtttgcataggaaacaccttgtttagcctaatctttttatttttattactctattagtcactacaactattttctgattgctatggtgatagatggtttaaaacaagccttcattaagaattgtcacaccatggtctcagtcaaaaacaccaacatttttattggtattgacaattatgggaatatccaattccaagaagacaaggagacctctgaactttctaaatgaagactccaatcttcctgatctgatgggaagcagcttggcaagattaccaaccaccaccacagagagtggactctaagctaagacttaaaagataagtagaaattatccaggtaaagatgtgtacagagaaggaagtacatccaggggaaaagaacaatacgtgcaaaagtacggaaatggtaaaaagtaatactacatagtcaaagccaagcagagttcagaagggatctggtggtgaaaaatacggctagagaaagcagcaaggattggcttctaaaacctatgtagtatcttggaccttaccctaaatgtaatgagaagcttctaaagaatctttcatttattcattcattgaacaaatattttgaggctttctgtgaagaacatcattctaagtagtaaagatacagcagtgaataggacacataaaatcctagatctcacagaattgacattccagagagggaaaggtagacaataaatacataaacaaatcatttaacaagatgatttcagacaatggtacgtactgtgaaaaaaatgaaacaaggtaatggacagcgaaaaggcactggaaggaagcctgcttacctttgcatggttagaaaagatctctctaagaaagagaccacatgtgagctgcgacctgaaggataccgagaagctaggtgtgcaaagatgtggggacagaacttttggactgaatagcaaatacaaatgcccttgggtgcaagctttgcctgttcaaggaccaaaaagaaggccagtgtgcctgcagcatactaagcacagaggaaaacactgttatatgctgagattggaattataagtagagccagataatatagtctcttataggtcataataaggcaaccagattttattccaagaggatttaaaaatcactggaggttttgcactagggtgagaggtgtgatttgtatttttaaaagataattctggagaattaactataatgaggtaggagtaaactaagttaggggctatttcagtggctcagacaagagataatggtagcttagactaggatagtagtcgtagaaataaataaaagtggcactctactttgggggtagagtctataataggtttggtttatggatcatatatgagagtaaaaaaaagaaaataaattaataatggttcctaggtttgtacctgagcaactgaataaatgggtgctgtgaattgagataaaggagattgagaatcacaggctttgttttgcaaattaattttgagaggcttattagacatcccagtggagatttcaggtgagtggagcccattgaaaggtaagggacagggtcaggtgtggtaggtcaggcctgtgatcccaggactttggaaggccaaggcagacagatcagttgagctcaggagtttgagaccagcctgggcaacatgggaaaaccctgtctctacaaaatatgcaaaatattacctgggcatggtggcatatgactgtggtccaagccacttggggggctgagatgggaggatcacttgagtacaggaggcggaggttgcagtgagccaagatctcgccactgcaaaccagcttaggtgacagagtgagaacctgtctcaataaataaataagaaacgtaagggaaaaggaaattaatctgatcattggcaaatgcatagtatttaaagccaggggagtagatgagatactcaaagtaggtgaagataaggaggcaatgaaggcctaggactctggtgtacatttagatggttataagaggaatagaaactggcaaaataagtaacactgagcacccaatgaggtggagaggaaagccaggagatgaagcatcatagaaggcaagagaagaagggtgtcaaagaggcgaggcagtcatcaacttctgggcagtcaaataatataaggacagaaaagtgaccattggatttggaaatatgatgagcactttgagtggagtgttgagacagaagaccaattagagtagattgaggagataacgagaaatgagaaaatgtaacctgcaagcacagacaattcttgagagacttttctgtgaaaggaaacagacacagagtcttagcatgtcttgtctttctatgggaaatgtaaatagtttgagatcagggatagtattttattctgctttttgtacctctacattacctagcatagagctagctaatgtgcacttaagtatgttctcaattcttatcgcctgaatgactggatgggtgaaagaatggatggatggatggatggatggatggaaggatggatggatggatggaagacttctgatttgccaagaagaggatactggtagcagaaataaaaacagcactggagaaagaagagtttagatttttattctttggtgtcagttagacaggaaagtaagacattagaagagtccttagataatttatgtaattgttcacttaggatttttaaatgtgatcactgatattggacatgttcctagtgaagcatttttggtgtttcactggttgaagttaataactgtaaaattatttcccgttcaggacagaaaaacagaaaacttgaagctcctattagaaagttcaagattctctggggttcttaggatttactgttcccaaaactctgtcaagaacaagaaaatgacctgtatacttaactggtctaggcaacagtggaaagacaattctcagagaagatttgttttaagaagacactttccataggaatcaaacaatagctttcagtgactaacatggtaagacacagggtgttagctctttccttccaacctcatggctgttgtaccttacctttcgaccccgtgttcctgaaattgttaaattcataaacttaccaaggactaaccagcctctggggaattgctgtatacttagcaaacttacaatggacatatttataagccataatgataactgactaataggaaataccctcaactgaaaatgagagatcatcatttgcaaatgagttcccttgcccaggcaactactggggaaaatgtcatgcaagcaaaattaatctttgaaatcctccttttccattttttgtgtcttccttttccataggcaccagaaatatcatggtgcctggatctcatctctacagaaaaaaaaagtgatttgataaactgatttatattgtgtccaaatgtgattgtattttcaaagataacctaaggggagaatgctgtctggcccaacagcaggctctcgacttcatttcagacactgtggccaatggctgggaaacaggtatgaacagtaggtttctgagtcccctggaattattccatttatgtagccacctccatgacaggaagcctccctactcttacttcccagtttgttcattcatggcaccaggttgcagattaaaatttgctcagtgaccttttatctaataatgtgttaccttcttctcttaaaaagtacaagggacaaatgctcatggtatacttttaggagattgtggctctctattaacagtatttattcaacaaacatttattgagcatttatatgtgcatcatgctagggactggaacctagtaagtgtagcacatattatttcatttaatcctcacaacaaacccatgaggttggttttatgatcccaatttttcagaagaagaaactgatattcagaaccagttaactaactggttcaaggtcatgcaatttctaagatacagaaccaagagtcaaagacatgattttaaaccaaagctttttctgctactccacattgcttccctaggtgagatctgaggcattccgcgaaaagagaagggtcataaagccaagggaagacaagcttaggaaaaaaaagggaaatgtcctaaataaacagctttcctatttaccagaaaccactagtttaaaaatataatgggaaaaatcctattcactttaacaatgttaaaaaaaaaaaagatagaagaaacatagggataaacttaacacatttgtaggatatgtaaagaaactaaaagatgttaataatggcctaaagaaaaaaaaacttacatgtatggggagatagaccatcttactggattctaatatttaatagtctaggtgttccatttctcaccaaattaatgtatacatttaatacaatgtcaaacgaaatatcttaggaattgcttacaaattgtcagataattacaaagtttacctgggaaatataagcatatatgaagagtgaatgggaccccaccactccccccaaaacaaaaaaggtctgaaaaggacagaaatcaaggagagtcttgcctgccagatacaaaattctattataaaggtgtattgatgaaaacaatttaatactagtgtagcaataggcagcaaagcaatgaaacagcataaaaagaccagaactatacctaattatgatgaagatttaaggtatgataaacatgacataattcaaatcagcagaaattggcatagatagggttaagacaaatagctaatcattagaggggaggaaggaaaggagggaggataaaattaggttcctgccttcatcttacattaaaataaattccagatgtattacatttaaatttttttaaaaaaagaaaccacaaaatacttgaagaaaatataagttgttatatagtcttttgatgggaatttttttttttttcagagacagggtcttgctctgtcacctagcctagagtgcaatggcatgatcatggctcactgcagccttgaactcctgggctcaagtgatcctcccagctcagccccccaggtagcaggaactacaggcatgcgacaccccatccaacttattttttattttttgtagagacaggggtcttgctttgtttcccaggcttatctcgaacttctgccttcaagcacctcagcctcccaaagagctgggctgatgggacattttttaacatagtgccacattaccataaatgaaaagcttgtaaaatactaatttttaaaactaatatatatcagaaatttttataaacaaagttaaaaagcaaacacaaaaaatttgtagcacttatgacaaatatatgtatatatatgaatacaaaaagagcctttacaaaacagtaagaaaacaatgaatactcccaatggagtattcaaaactaaactgctaaaagcaattcaaaacaaaaaacataaactatgcatatatgtatgtgaaaaagtttaaccttatcaaagaagtaaactctcaaagaaataaacatcaaataaggaaatagccttttcccacaaataaccaaaatctgtaagaatactgagctgcgaatgtttcagaaaaaaaaaaaaatcatacacctagttcggcatgtaattaatatagatcagaacactttaaaaatatttataggccaggcacggtggctcatgcctataatcccagcactttgggaggccaaggcgggtggatcacctgaagtcaggagtttgagaccatcctgaccaacatggtgaaaccctgtctctactaaaaatacaaaaactagccaggcatgttggcgtatgctggtaatcctggctactcgggaggctgaggcaggagaattgcttgaacccaggaggtggaggttgcagtgagctgacattgtgccactgtactccagcctgggcaacaagagcaaaactctgtctcaaaaaataataataaataaaaataaaatatttatatactctgacccatcaatttgtccagcataattaggcatgtgtacaagggtttacacacaagaatgcctattgcaatattgcttttaatgctaaaaaaaattggggaaaatgctttaaaaatatagattaagactgtacattgtggtacagtcatataatcaatagtatacagctattatttattttcagccactgtccaaaatatagcctggcctaacaacattctgttaggatacgcaagcaccgtgaggagatcagctataaagtatcagtgtttcacaccactgctcctttgctaataaccttcaatggcttttaaagaagtaaaaaacaaaggcaaaattccttagtcagcccttaagactctctgttacttagctcaaactacccttttcaacaacactgccctaaccaggatgagttttttgcccccctggagtacattcagcctttccttatcaaaccttcctttaaataagtatcttctccaggaccacttcactttcttccccaatttagcattttctatatctccaggcctacctctataaagcctgtcctaaccactcaaaccctagctttttctctgaactgctagaaatatttttctctcattggccatttaggtaaaaaggtttttactgtttattacctactcaataaaaattttctttttttgagacaaggtcttactctgtcgcctagaatggggggaagtggtgtgatcacaactcactgcagcttctacctcccagctcaacagtcctcccacctcagcctagtgagtagctgtgactacaggcatgtgccaccataccccactacttttcattttttattttttgtgagatggaatctcactatgttacccaggctggtctgctgatctcaattgatcctcccactgtggcctcccaaaatgctgggattacaggcatgagccacaatatctggccccagtaagcttttaaggccattaacatgaggaacagtgttctttacactattttatcagctagggctttgcatggagtaggagtttagtaaatgcggttgatgggttaatcaatgtgtgaaaatattcagagccaccaaaaacagatattatgtctattctcatcaacaatcaaaattgagtaaacagccattttctaatacaggaaaccacaaaacattgaatggtgacattaaaaaattcccccagcaggagccaaccaattttttcatcctgatccaagttagcaaactgcaaaagataggaagcactaatgagtggaaatttgagtagaagcatttcttatgaaggctgtcttgactggatcacatttttattgctgttggaggtgccaaatgtgtgtgtttatgctaatcctccacctcaggcaacacacagtcaaggatcctaccaagtgttaccgtcaagtgtctgttggcagctcaaggccccagcgttgttcccttgcactagggaaaagacatattccaggtacaagtactcccactttgatgctacagaggagttgctgaactttgtgtcattaatctctcttcgttagatcccaaccctgtttaaatcccactatctgcctactctgggtcttcaccaatttactagatcatagttggagaaaatctacaaagccttgctccctttagatttaaacaggtctccgtttaaatttagaattgctaacttcaagcgggcccttatgcgacagtatgcctgtcagtcatactacatttcctcaattccattcatgtgactgctccatacccttccctctctcttcatactactattatctcttcccccctccctcatttttaactgatgatcttgtttcctatttctctgagaaaatagaagccatcaaaagagagtttccacaaactcctactgccttatctagccctgtaccatatactttgcatttcctctcattaccatggatgtactgcctatctgtgcttctatctaaggctaacccttccacttcagttttgaatattatcagctcttaccaactcaaggccattgctctagcaattctctcattctctctcattttcttccatcaagttttccttttcttcaattaacagagtagctcctaaagggaaaaaaaagtcttctttttcaatgctcatcatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctagaattagaaataccatttgacccagccatcccattactgggtatatacccaaaggattataaacaatgctgctataaagacacatgcacacgtatgtttattgtggcactactcacaatagcaaagacttggaaccaacccaaacgtccaacaatgatagactggattaagaaaatgtggcacatatacaccatggaatactatgcagccataaaaaatgatgagttcatgtcctttgtagggacatggaggaagctggaaaccatcactctcagcaaactatcacaaggacaaaaaaccaaacactgcatgttctcactcataggtgggaattgaacaatgagaacacttggacacaggaaggggaacatcacccactggggcctgttgtgggatgaggggagtggggagggatagcattaggagatatacctaatgttaaatgatgagttaatgggtgcagcacaccaacatagcacatgtatacatatgtaacaaacctgcacgttgtgcacatgtaccctaaaacttaaagtataataaaaaaatatatatatatatataaaacaactaaaaataaatcttctttttctgcaggatcagtccatcaccacacacacaggctgtgttttatgttgttccccagcttaagagatcgttctccagatcccactgctccttccagttgtcacctcagttctccacttctttttgctgataaactactctaactagttacatatgatttctgtccccaggtcccctccctcagttgttttgaacataatcatttatatcatttatcattttcactctaattgcacaaccaaaaactccctttttttttagatggagtctcactctgtcacctaggctggagtgcagtggcatgatctcggctcactccaacctccgcctcacgggttcaagtgatccccctgccttagcctcctgaatagctgggattatacacatgcaccaccacacctggctaattgctttgtttttgtttgtgtgtgtgtgtgtttttttttttttttggacagagtctcactctgttgcccaggctagactgcagtggcatgatctcagctcactgcaacctccacctcctgggttcaagcgattctcctgcctcagcctcccgagtagctgggactacaggcatgcaccaccatgccaggctaatttttttgtattttcagtagagaccaggtttcaccatgttggtcaggctggtcttgaactcctgacctcaaatgatctgcgcacctggacctcccaaagtgctgggattacagacttgagctactgcgccgggctattttgtgtttttagtaaagacggggtttcaccatgttgtccaggctggtctcaaactcctgacctcaagtgatccgctcgcctcaggccctcaaagtgctgggattacaggagtgagccaccatgcctggccataaaactgccctttgttaatatgactgttggcctgcacattgtcaaatccagtggcattcatcttactcggccaacctacggcatttgacactgtctgtctttccttctgttcctctatctgtttccagtatactggcctggctttctttttacctcttttatatgctcttccagtctcaggctcctttggggatttgaaggtatgttgcattttgctattcaatgaataatgacaagtaatgatcacttaagacattaagtggtcagttcctttactaggataaaaataattttcttcccaacatggggcatattccatttccagtctgactgttctgtgtaatctttgtattccttggcagccccttttatatcagttcatctactgtgcaggaaattggacaaacatttgcactggtataaccaaatacagttgaacttttggcttgactcttagctgaactcaccaaaaataatttctgtaagagactgagacgtctacgagtaggtttttcagaattagtaaacataaatcaaggatacacaggtagatttgaatttcagataaacaacaaatacttttttagtatgtctactgaaatatttgtatcttatctggcaattctacctggtacagaactaatccattctcttgaaagatcttgactctgtaataagttctttggtgatggaagggaggtatttctgtaattagagtcactgtcttcctcccagttttttatcctggcccagatctgcaatgaacacacgacagaatccaggggggatgaagatgggtgctttgcaggaaaaaaaaattaaaaacatctgaaaaagcttttgtactaaaagaatgtgatctaaaaaagaaagcaggagaactttctgtctgcactttacatcagaacaaccttggcgtctagaagctgtgccctgtgggaagtggtggtgcttggtaagagatgccaggaccagtggtacccactgggagcactgccaatacccagcaaggagcatgggtgcacagtaaggcattgcactgtgattcagcataaaataacaataagggaacgtcacggagaaaaggccagacttcctttgtttagaatgtgggaaatgtcttctgaaaaatggtagtaaaaaagcatgcttggatggtccactccaggcaaaactgactaatcgggggtcagggatacaacccctgcatcatatgtttgtttctgttgggctgacatgaggttcactgtgaccactgtggtttaaccccatagtctcctggaaatacagccaggtcaagagagctccacataaaacataatcaaaaaaataaactcaagtttccactgatcagcttttcacaactcttatcctttcactaactttggagcaagatttgagaattggatggctatttgagggctatttctgcgctttagttcaatgttttgttctttctttattagagaactatggttttttattatatttacactttaagttctagggtacatgtgcacaacgtgcagatttgttacacaggtataaatgtgccatgttggtttgctgcacccatcaactcgtcatttacattaggtatttctcctaatgctatccctcccccagtcccccaccccccgacaggccctggtgtgtgatgttccccttcctgtgtccaagtgttctgtttatgtgatagattacgtttattgatttgtgtatgttgaaccagccttgcatcacagtcacttgcttacaagaaacaaacacttcacagatggatcattatgtgtgataagtgaaatccaaggatttatgctcagaggtgggcttaacaggtaggaagagcagtattttccttcaaccatgagtgtatgcaggtttttcttttcttttttgagatggagtctcactcttttacccaggctggcgcgcagtggtgcgatcttggctcactgtaacctctgccacctgggttcaagcaattctcctgcctcagcctcccaagtggctgggattacaggcacctgccactgtctccggctaatttttgtctttttagtagagatggggtttcaccatcttggccagccttgtcttgaactcctgacctcatgaatcatccttctcagcctcccaaagtgctgggattacaggcatgagccactgcgcccagcccacaggtttttcaaagactaaacttaaaaaaaaaaaaaaaatttcccaatgaaatataaaactaaagtgctaaactgtgatagactgttttacaagaatgccagttttcacaagtgtctatagaacatgtaatttagataggtaagatgaaattttgataatatttgatggcaaatttaaacaggtatacaacaaaaataaaattctaagcccctcaaccaactgaatggactccttctctcagccaaaggaataccaaagtaaacctgaaaaactagttttggccaggattgggggtaggtgggggaagcccaacatgactcattattctctcctccctttggaattcaggcacaactgaatgtcagcattgacactaaaacacagatcttaagactgacaagccagactctttgtagcagagagccaggccctggaagaaatcaagttattttatcccaaaaaatatttctttgatatattttcaaatggccctgcaaagctgtctcttgtggggaaaattgacatgctgtacagaatttccttctctttccaagtttttactgatccaggagagatttaactaagaggctagcatgtttttttttttttttttttgaggcggagtcttgctctgttgcccaggctggagtgcagtggcgtgatctcagctcactgcaaccttcgcctcccgggttcaagcgattctcctgcctcagcttcccgagtagctgggattacagatccatgccactatgcccagctaatttttgtattttttgtagagacagggtttcaccatgttggccaggctagtattgaactcctgacctcgtgatccgcccacctcggcctcccaaagtgctggcattacaggcgtgagccaccgtgcccagcacaagacatttaccgtctattctctctgaagctactatctagaggcttcatcaacataataagacccttggtctccacaactccttatcttatcctattagtttctactgattccaggtctttagataataacaactctttcaaccaattgccaatcagaaagtctttgaatccacctatgacttaaaagccccactccttcaagttatcccgcctttctggactgaaccaatgtacaccttatatgtgttgatggatatctgcctgtaacttccattcccctaaaatgtataacatcaagctgtaacccaaccaccttgggcacatgttttcaggaactcatgagactgtgttgcagaccttggtcactcatatttggctcacagtaaacttctttaaatattgtatagagtttggcttttttcattgacacaggaaaaataaagaattggaaggtctttcatcagtcactgagccagcttcatatctgactgaggtcatacagttcagtgatttgtagctttgctacttagattgctatccattatctagaagcatcaggatcacgtgggacctattggaaatgcagactttcctcctagaacccaggaccttggaatattcttggcacatagtaggtgctcaatacatattgaactcctaggtgcaattcattaattcatgaattaatgaattaacacgctctcaaagtttagtgctttttcacagactagtctttctgcctcttaagcactcagctcaccacgcttccagtctcactcccctattagtctgattaaaatctgcttacatgtgagtctgagatcaagtgttatctcttctgagaagtcttccctcactggcccaaaggaatttctcctctattttagcactgtcccagttgacttgtcattattctagtctttttcatattagttgtttttcatatatatgttattaaggaaactagtcatttcccctaatagaacaaaattgctggcctttggggttggcaatggaggggaggctcttcttgaaaagggggaagagtgttctcctaatatttttcttacgagatttatgttgctcatctttagcctttagtcccccattgcctgcctacagttggcagagaccatctgttctctcactgtcaggaactgtctcaattcttgaagttcagagtcaaaaaagaagcaagttttcctagctctttgatcaactttcaaagttttacttccatttgaaaatttactaagtcaccaggagatggtttatactgagaaatatccactcatactcttcctcttcaactttcttccatatacaccctattacagggatatagtcttactctatagctcaaaaggatgaccctatcagaaacctgcacagtatgtaaaacattctcaccagaggttcacttgtgtatttccaccctagaatggaagctctacaaaagcacagaatgtatcattttaactttagattctattttcacacccagtgcttgacacatgatttgaagttaatatttatttatcaagtgattgttttaaaatcatgactcactcaacaaagttataagaataagaatagtgttacagaattggtatacacaagctgaccataatcaacacacctattatcatttttttgcgacaggttctcgctgtctcaccctggctggagtggagtggcatgaccacggttcactgcaggtttgaacttccaggctcaagcaatcctcccacctcagcctcccacatagctgagcccacaggtgtgtgccaccatgtccagctaactttttaattctttgtagagacagggtcaccctatgttgcccaagctggtcttgaactccttggctagagagatcctccctccaaggtcccccaaaatgctgggatctcaggcaagagccaccatgcctggccataatcaatacacttttaagaatgctagaatgttatatcagatgcatacttcagcactatctcaagcaaactggggtgtgggttattctacatataaagttcagcagtgttgttccacagtcccaaactccaactgaggtcaaatgtagggtgcagcaaggtcactggggctgtcatcaagggcctctccttgcactcttgccaaccctgtttcttgattgtctctaccaccatgagtcaccagcaatctcccacagtcacttgtttaaaagttcacaagtattgtgtgaattgcaggcaaccccttgactccctgattgcctggtcttcttccttgggctctaccattttttttccccagcactctttctgctgctctaaattttaattcatgcaattccatatgtgtttctctatcattcttcatctctttcctctcccttccatccaattttgtttgtctgtttgcttgcttgcttgctttaatacatttctctttttctgagaaggcttgagtccaaaactctcagttacctgttgttctgtttcccgttagttaatctccgaaccttcataaattaaatctgacaaagtcccctgactaacaaaggaaatgcacaagtcacagtaaaaggggcacacacagaacacaaatagacccagggtcttttctgttcatcactcagctttttataggagatccaggagaaatgaagtggaaagggaagtgtgttgagttactatacaacacaagagtaaactttcttataagtggtaatttttttttacaggaataattgaaaatggaaattaccttctctactcatagtaagtactcagtgcgttcttgatgggatgagaatgtgtttgagctttagtgtaaggcagaattctgtttagtctgccagtattggagaaaaataaaacacaaagggactgacatgtaggaagtggcacctgggagggtctcaattcttcctattacaaaaatgccccagagaaataaaaagcttgtgtacatgttgagatgggagagttctctggcccccctcgcaggatgtgtgacagtggggtggctctctgctgcgccaccatgagctcaaacccctcataggagggggagcacacaggcaggaaggtgcaggagctgggcgagctctttgggctctggccccgtggtactgtctagaggtgggtgcctgcaactcctgaaagcccaagtgggcatgtgttacagtgcactctttcagctttgctgtctgcagcttaagcgttaaccagctcagtttcttcttggtacccaggtccttgtctggcatccaggaagaatcaggttacacatggacttgaaggatgaatgtgggagttttatggagtggtggaggtggctctcagtgggatggatggggagctggaagggggatggagtgggaagatgatattctcctggagtttggctgtccagcagccgatctcctctccagtcgtccccagcctctcgacgttcagatgctcctcttctctccttctctgccatgctgttctgccgttcatctgcctgtctctctctggagcctggaatttggggtttatatggtacacaataaggggcatggcaggccaaaagggaactttttaggtgcaaaaaacaggaatgcctcttctcacttagggctatagattttcaggcttgaaggtggggcctttaccagcgaacctgtatttccctgtctcctgtgcatatcaatgtaatcaaatactgggctgatccaggatgtttctttagaccaattatgggtaaaataatttacattcaggtttttatatttgcttttgtcatttctttttaagcaatcatgtaaaatatctatacgacagtaatagatgatagcgaacctaattaaaattaccagaaacttaagaatctctaatgatttcaactgtaactaaggttatttctctttatgttgaacaatgttgggagataagacacaagagtttctgaagtatttcagaaacacaaagagggaggttatataaataatatttttttcctactttgggaaaatgaaagctagtcacaaagttaaacgagtggttattttaatatttaaaatacaggcttggatgtatttcctgttaaagaaaataaaatgcagaatattcaaaacgtctgaccacccttctaagaaaatgcatctctgaggtatttttccttagaagttattgtaaaaatcctggagaagcttgaacacagcaaagcaaacaggatgcagagtttaatctgtggaaagcttagggaagaaaagcaaatcattaaaaataggtcttcctctgaagatttttaaaacgcaaagagggtggaatagcaatgataataaaaaagctggcatagagagtggcacaatttgctgtgccactgagctgactggatgtgttctgaatttctaggcattagtgtacctttccacacgcattctccctttaaaaaaaatgcccacacactgaatacttttttcatgcaatttaaaataagcgcaccatctagtttacagaaattcactagaagttatttatcctaaaatagcagagatctagaagaattttgagctctaggacattttagacacacagaaagaagaatctggacaagtcttgaccagacatgacagaatagaaatttcttttcctatttatctctttgaataaaattttcaggatcttacagtggacaagtttgttatctacacattgtgaagcacattgatttctcctctgtagccttaggaagatctgagaggtgactgagctgattgaatgatccgtgaccgctctactgggaccagtagtagaactttactggtggagacctgctggaggtttgagagcagactttgaaaattactagagctacacagatactgtgtggctaactggattatgtttagaggctttcagaactatgctgctgctgctgcagtgtagccaggacgcacagagaacatctaaggctcttgaatggggcgatagggacagatttcagcagccatctgacttcagtgctcattttgatgctttccctgcagggtgcagtgtgcagtgtgcagtgtgcagtggtgggaggctcacacaggaatacttgcttctgtagccctaatttccggttcaaactctgcattcaccttgacagattctttccttggccaaaatttagttaggcttctgggctttctcttatgcccacctgcagactttttggtaaaatccagttttagtaaagagctctgctaagtcagtttagcaagaatccccacctcaaaagtcactatctccctccctggtagtgtctggcttgtcttcagcgagaattctattaggttctgttagattagaatcctccttacccttgatgcttcctcttagtattttttcatccactgactccttgacccaccttgctcctcggctataaattcccacttgcccatactctgcagttaagactattttctccccactactgcaaaatcccattgccatggtccctatactatctcaatggtaatgaataaagtctgccttaccatgctttaacaagtaacattgaaccatttttttctttaacaatctgctgcacaatgagattactaaaactttattccattttgccatgctggatgtcctcaatggaatggctcttgtgagcaccaaatcattgtgagaaggaaaacccatctcttacagccccctgtaacgtgatgtatgttacatgtgatgtatgttacatagttttttttcatgttgatcactttttgcccattttcctatatcttatcagttggaagactgtggaagtttgtagtactaagccacaagatgactaagaagagttgaaagggcaagtggggctaaaaacagattttgtttgacttaccccaccattccccctatcatggggctgaatctgcctggaggaaggagcatctttatctttgtactgtgaaccacacagtctagcagcagcacagccaaggcacttggggtttcatgagactaagtacatgcaattctattgtaaaggcttaaaatatatacaactgacccttgaacaacatgaatttgaattgcatggtcagttatacgcagattttcttccacctctgccacccctgagacagtaagatcaatcaatcctcttcctcctactcctcagtctactcaaagatacttgaagtctacttgaagatgacaagcacaaagacatttatgatgatccacttccacttagtgaatagtaaatatgttttctcttcctcctaattttttaacactttcttctctctagcttaatttattgttaagaatacaatctataatacatatgacatacaaaatatgtcttagttgactgtttatgttatctgtaaggcttcaggtcaagagtatgctattagtggttaagttttcgaggagtcaaaaggtgtatgtggactttcaactgcaggggggtgggcacccctgcccccatgttgttcaagggtcaactttactgccaaaggcaagcctttacatccactttttccatcccatcagtaaatggaaaaagatagctacagtatccctgcgtcaaatctttttttttgcagatcacaaattggccactcaccttgctctgtgaggggtaaaatgccccactttctttagtaatatttaagttagataatatttaagttataaagttgttctttgtaatcgttaattgtaatttttacatagtttctttcaaacagaaatagcatttttgttagataacctcccgtatagatgatgaaactccttttaagggctatctgaattttaattccttgaaaaggcagaaattggatagctagtagtcataaatgtactgtggcttcccccaaccatctgggctatatagaagctgcatccttggactgcagtagaggagtcttacaaagcacagagcaacttctctcctgggttgcgctagttatgatggcaattttaaatgtgtacttttacccaaagaaaatccttattatcaacaatcacaatgccatcataaccatggtataaaaaattcaaaatgtcccagctgaagtggaggcaaagactcaagttcatggagtcagagtttccttgctattcctctttttcaaatgaccatttagtaagcacctgaagaaaatactatggacggcattgaaaagtgaagataggtttaatcttctcgaaaatctaattctccagatgaaacgctgacacttatccaccccacagaccctatagcagatgtgtcactggccatcacatttgacacagagaagtcataactcagtcagcacagagacatttccatgagtttctgaaccatggacagaacgtcgtctgtgggacatgaaaactggaacttagaggacaggcacatctgagaaatgggcagtttaaaggcagaacatagcacatatgtgactgggttttagaagcaaatttacaagacgcactcttcttcatcctaaataatctgcaaccaaagcttccaaaaaagacaatttaggaatgcagaggtgaggagtagggaggggaatgggatgagagagagtggagattaatggtgggcagagcgaggtttagaacttagtggtttcttcaggttctgaactgaaatttgtatactgtaaaggcacaaacaccatttttaacaaaagtgagcaggacttcctatctggttcagaaaataggtgaataaatagtacgaattattaaaaataataatttccacttatacataggaaacttgataggaaccatgataaatgcttaactcttaatcttcaaggaactctgctagggatataatattataaatcttgttttgcagatggagaaattgaattttaacccaagttatcataacccttaaatgattaaatgatactgttacatgagaaagctgcgtatctgtttcctggatttgtagccataatttgtgtctcaagtcccttttgctgccagctatcttgggtaggtgtgttccctttgggctgtttgatacccccacatttatcttttttttttctctttttttgttgagagagtctttccctgttgcctaggctggagggcaatggcgcgatctcggctcactgcaacctccgcctcctgggttcaagtgcttctcacgattctcttgtcccagcctctctaatagctcggattactggcatgcaccaccacgcccacctaattttgtatttttagtagacaaggggtttctccatgttggtcagggtggtctcaaactcctgacctcaggtgatctgcctgccttggcctcccaaagtgctgggattacaggtgtgagccaccatgcctggccccaaatttatctttaatgccccaaattatctagttcccatgactgggcttctgctttgatcctttctgcacttgctggaccctctccctgggaaatgagattgtgtcctgagcccctagttagaggctatgtctctgctgttcctgaatgggcctcctggatgagacctcattaaaagtctaattctcttggagaattgagagatacctatttgtctcaaaatcattgaaaccaattaatgtattatgagcctctatccagtgatttgtacctcaattccccaatccagctgtcaaggccaatttgttctaccttacctagtaggtaagtctggaattgtagctgtggcattttcagtaatggtactctaggttagcagtccccaacctttttggcaccagggaccagttttgtggaagacaatttttccatgaagggctgggcaggggagtggtttcaggatgaaactgttccacctcagatcatcaggcattagattctcacaaggagtgcgcaagctagatccctcacacatgcagttcacaatagggtgtgcactcccatgagaatctaacaccgctgctgatctgacaggagacagagctcaggcagtaatactcatttgcctaccgctcacctcctgccgtgcagctcagttcctaacaggccacggaccagtactggtccacggcgcaggcatcagggacccctgttgctaggtataagcatctggctgctgcatgtcttctgtgtagctacatctgtatgtgtatctgatgagatataaattatttgattataaattactttcttcatattagagttgtgaatgagtatcacatataattatacataaactaggaatatgctttttaataatgtatataagtaagtttccttaactatgactttcatcttagcgtagtaagagggtgctaagaaatatttgtgatgaaaataggcattggtagagttgagaccactgggtgatgaaagagtgtaaagattttaaagccttcagatgctggttcaaggtgagaaatgtgattgggagcaaatcaattaacttcttgaagtcttatagggcagttatgaatacttaatgttaacatatgtaaagctcttctgccctgtatacagtaaatgctagttagctattatgatcactactaaaatggggatgacataaacctcataaggttttaagtattatgcaagatactatacaaagtccagtaaatatcacattcaattgaatccatgatgtccgattattttagctacttccaagagagaaaaaaatgctgtcagttttactgttcttatagagagcaaggcagatcccaattcccaatgtggtaacgtgaaaatttttgcatttgaatcaacaaaacactttctcctttctttcctactatttaacaactggtaagtctatactcccccaaatctggaattctcctttcttattctttttcctcctaccaagaccgcaggatcttttacttggctataaggggtaaacctcaagtagtacaagttctctgtattacttttatactctgtcacagattccctttgtttcctcatctccatgtgaatttagttaaattctcagcattctgatccttactatacaaggtaaatgaatataaaaacaaaacgaaacaaaaacctcttcctatttacataaggccccaacctaatatttagtgatatatattaatgtgaacaaggaactaacgaagactgggaagaaattcacagacttgagagaagaaatggcaggatttcctgggaacaatttcatgtaacgtcaaaggtggtaaaaggtcaaatagaatgaagatggagaataccggattttcttacaaaatgatttcccaggagatctcatcaaatgcacgaggataccttctcagtttcacctagtgagtaaaagactggtaacatagctcacttacaatttggataaacaaaactaaacaaacaacatcaaaatttcagaaaaaataatagcaaaacagaaatcaaacactcaaatttttggtccttctgtttatttcattttggatactcagtgaatgttaattaaccaggaaacttaaaagttatttcaattatgaacctcttcaatccttcatcaattattttgagtattctggtcttaaaaacatctctttcttctacaaacttctgaaagagatgaacacctccacctacaccaaaataatgtgctttgctggccaaaagtacacgtccatttttacttaacagtctaaggaaagtctggtgcaaattactataataatctgggttgtaaatggtttctgaggtgagaatgagatcatattttacaaaaagtttttcactacttagtacaagcttacaaaactcagaccactcaccagaaaaaaatcggcatttatatagttgtgttacttttggtttcctgcatcttttcacatctggctcatttacatcattttcttcatcttccaaagtggagttagctactacattaggtaaggttacttcatcaatcaccatactgttataatcttgaaagtgaatttctttggaccctcccttgaatgcagttatacctagtaaacctgatccacaaccaagatccaagacttttttcccagcaaatttcactttggcctttgtgaaataagccaggaggtcaaaggtacattcccagatttttaagcctccctcataaacacctgtaatcagatcagagtgagaagaaaagctttttgaaactatgttttctccagggaagttctctttcaacaagatggttttcactactgataacttaacatgctggaaacctggtaatgtttctatgactttattttctaacatcttctttaaatctttaggcatagcatgctctttggcagctctcaaggagggctgttttccatgtggctccaagttccttgaactgctggctgcactgagtggactgtctgtgtcttgagagggagctgcattttccattgacttatgttcccacaagtgatcctgaggcaagtcaaattgttctgcagaacattttctgtccctctcttctcctttttgactttctgagactgacagctcttttgaggaatccagggtcaaagctccatctctaatgggtgttaattcattttccagatggtcttctatagtgaaattaaactgaaaggtcatcctcttattaaatgcacacaatctttaaattcagattcttcaacttctggatagaatttgatgatacacacaaatctgcctcaattattcaattagttttgttgggcccaatttctctttagcagcttatacatggtaacaaatatttagagatatttccaaatgactttttagacgtctttggtcctctttccaagcagctctggaaagaaaaaaaaaaaaaaaagaaagaaaatgatgattaaagcaaaatggcacatttcactaaagtgtaatattaaacagccacccccacccctccctgtcccaccatacagctgctttttcttaaaaagttgtggggaagagagagagataagagatttggacactcatacacaccttaagggttccaaagtgggagaagaaaatcaactataaaaacaaacagaagaacaacagcaaccaccaccactaccacctggacaaacataaagtccaagatattcagacaggacagcctagctacttgctgtctttcagctgtcttgatttgtgtccaaccatattcaccccctaagcttccagaataacttcacttctgtcttttacagaagaggtgcagtattttattttggtaagtcagcgtccctttaaaaacatgcataggtatggcctggtgtgtgtaaattcatccaagacttcactccaaacatttagtcgagaacagcagccctaagtgtatagaagtgggggtaatttggcaataattagtaaagactaattcggtggcagagcaaacgcaaactagggcactgcagtagtttggagagacctgtagaaataagaagcaactttattgagaatcttctatctactgcgctagacactataccatctgcctcaattttcacagttctggcaagtgggatctttgttccctttatacaagatttacaatttgggggagaggcgggtcacccagtcccgcggctaggaacgcgcctctttcctctcccatcacgctgcaaggcttggagtcacttccggctgcaggtcccggaacaaatccgaccccagaagtggggacttctggccctcacctccccatttgaatgtaatgtttacagtgatccagacctggggatgcttgcttcccgacgtgtcctgggatcgcgcttctgaaaaagctcacctcacaacgcctcctccggacctaaatcgcgcaccagtgagtcgagtcctccaggggctagagaagcccgactttctttccggccttgagggacccgggctcaccaagaaaccagccgccctcctctctatggttttggagccggcggagagcgcgcaagggttggcgggactgcgagtttccggtctgggctttggcgggtctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctcatatccttccttggttgtcacttctacctagagaagggtgtgggcgggtcgcgaacctttctcttctgtcccttcagacccaccgccaggctgggttatattaccgcggcctgaaccccctcttttctttgtcagtgagtgggatgaaaagtgagggactggaggggaagcgacaaccgtggtagatttaagtaaggctttggccctggaaagcctcgcggacgtgttctgacccaaggttttagcagtggatgtggcgttttcttccattccttctttcagtttttctgtactcgttgcttgcaattaagtgtaaatacttttgctagtggataatgggggaggcaaggactgagacctgcggtatgacgatagctctggctcttaatagtttgaggtaaagcgagatactctgagcttttgtctcccgtaaaaagggtggtgaatatgaataagggctttcttagcgttataagaattaaagggcatagttctgtggtgtgaaatctttaaaagatgttcagtaaataaaaatgattttcctccttcccctctcagacctctttttcttctttctttctttttttttgacaagttctcactcctctcacccaggctggagtctttctgaaagagttcttccgcttgttgttggctttcaactgttggatttgaggcgcttagcgccttcttcgtccgggtgcagcacattcttgattggtctcatgcctttgtggttgtaaatgtgcctggaatcctagcctttcatggtaaaccatatgtatatgtatctttttcacaacatttgagcccagctttatacaattacactcaaaagaaaaaaagtaaccttcacttgagagaatctcaatactgcacaaatattgtgcagctaaagccctatgtaatcacatagaagtcattcacctaggcattagcaaaatctcagaaggtgccaaagcccccttttttagtttttgtgtaggtacagaactgccgtcttcaaggagtttcaacttgaaaacaaatagccaccctcaaaacattcaaaaacacttaaactgcgtgcataatgtgtgtgagacatggtgttaggctttgggagaacagagacacggaacgtgattcctcttcttccccacaagcttatagagagacttcattaagttgaaagtcaacattcccacctagctttgcacttcaaacgacatattcaaaaaagcccaaacttcctctagttttcttcatctgagtaaatggtttcacaaactgaaaccttgaatcctctctgtctcacacacccgatcagtaagttctattgtttctgattccaaactatgtcttgaatcaatccgtttatctccatcctcattgctaccactctgattccaaacccttatcacctctcacttggagtattaatagtttccttgtttctactcataattcattattccaaaaaagttaagaggggaaaaacatagatctcgtcatttccctttttaaaccactttaccttcaaggttccaggtgatctaagccttgcccttctctcatacctagttaattaactacactctgttcatgaatacattaggctcacctacctcaagatctttttgctcagcctgatttgttctctcagccttttgcatatttcatgtttatgtcttggcccaaatgtcacttccttagaggggctttttcagagccttcaatcttaggcagttcccccaaacgcagtcttacacttgtatcacattggcctgttcagttttctaaaaagcacattaccattaaaagaaatgctcttgtttgctttgtatattttccacttctacacattatgttgcaaagttcataaaggcaggatgttgattttcttcacagcgttaccctcagcacctagaacagtgcctgacacatagtaagcattcattaaagggctaaaaatatttcatgttttaaaaatacttgggagtctaattagacaatactttttttcagcttaatggtagtattttagcttcactattttaacaaatgaaaaatttgcaataaatctacaatgccattaccccccaaaatctttttcatgttttgcattttacgtattattttccaggccttacctgcatgtctgcataatcataactgactaattttggaacagctggtaattatttgagctttactgaaattttttcatgaggccaattctaccctactgaactcaaatttgagttaatgatgacctcattttgattgctgctgtaaaaaataagatttcggaagaggaatgaattcttgtattactgtggtaggactatgggtttttttttgtttgtttgtttgttttgagacggagtctcaccctgtcacccaggctggagtgcagtggtgcgatctcagctcacagcagccaggttcaagtgattctccttcctcagcctcccgagtagctgagattacaggcacgtgccaccatgcccggctaattttttgtatctttagtagagatggtttcaccatgttggccaggctggtctcgaactcctgacctcgtgatccgcctgcctcagcctcccaaagtgctgggactacaggcgtgagccaccgtgcccggccgggttattcatttttcttattaacattctttgatgattcttatggtgttgttacagtaaaacatttctaacaattattctaacaattattcttgatggtgtatatgaagaatttattgtcgtgtatttgtaagctgctatgtgcagaagaatttcagtcaaataaagttggtaagataggtatgtaagtaatatgaaaaaagatagaaggtgatgagtgacttaggtataaattaagtacaatagaaatgttgaggaaagaaaaatttcttgtaatagaaatcggaagtacaaactgggcatggtggtgtgcatctctaatcccagctccttgagaggctggtatgggaggatcactttagcccaggagcttgaggctgcagtgaggtgtgatcatgtcaccgcactccatcctgggtgacagcaagaccgtctctctttttttttttttttgagacggagtctcgcctatgctggagtgcaatggcgcgatcttggctcactgcaacctctgcctcccagtttcaagtgattctcctgcctcagcctcctgagcagctgggattacaggtgtgcgccaccatgcccagctaattattttgtattttaagtagagacgggttctcaccatactggccaggctggtcttcaactcctgacctcttgttcgcccatctaggtctcccaaagtgctgggattacaggtgtgagccaccccacttggccccgagcgagaccctctctctaaaaaaaaataaataaataaatcataaacctgtggattattgtagcattgtttctcatctgtcaaaaatatttcatgactatgcatagtttgaaaaggcaagtttgtccctgggcaattttcaaaatatttctttaatgtgttttcacaatactgtttacctaataaatcttaagtttttaaaagcaaaattaagccagtaatttgagtccaattccaatctcttatgagtcattgcttaaatttcaaaagggttttattttttttttaggtttgttctgagtaatgaataccctattactatgatactagtatcttccttaattatcctactcattgtctcaacattctgacagttggattgagcatattcgtaagtaaaattgttttaactgtatgatgtactttgatgttaaggtccgagtccccacatacctcggtagatgtgttcttacagttttgtattcccttgaaatgtaactgttctctatgttacagcctttataaccttcagttacttgaaatgaacaaattcattcaaattccagcacttaaaagttttaaattacattttggataaataccaaagtgttttgttgatgatgtatgtataaacaaattgtaaatattaaacgttagttgttacgattagacctatataaaacatgatatgcagtctactgaatagctatcagcctctaacatgtttagtgtcatttagaaaatgctttctaaattgccaaaagctgattgtctaggtgataacaaatttaccatttggaggaagttgactttctcattttcatgtcttcatcagtcttacttgatgagattcattcttctagtcagaagagagtttagactgctcagtttactcatattttgagttagcttttctatttagagttcacttggttgtggaatattcatttataatttgaatctacgttgtgtaatgggacctaatttttttttcctttgtttttgttggagtctcgttttgtcacccaggttggagtgcagtggcgtgatctttgctcactgcaacctccaccttccaggttcaggtgattctcctgcctcagtctcccaagtagctgggattacaggcatgcttcaccacgcctggctaatttttgtatttttagtagagatggggtttcaccatgttggccaggctggtctcaaaactcctgagctcaagtgatcctcctgccttggcctccataagtgctgggattacaggcgtgagccgctgagcctggccccagagtttgttttgttttgttttcaagacaagatctcactctattgcccaggctggagagcagtagtgcgatcatagctcactgcagcctgaactcctgggttcaagctattctcctgcctccatcttctaaagtgctgtgattacaggtctgagccatgatgcttggcctgtgtttttgtttgtttgttttgggggacagggtcttgctttgtcaccaaaactggagtgtagtggtgcgaacatagctagctcactgcagcctccatctcccacgctcaagcaatcctctcacctcagccttccaagtagctgagaccgcaggtgcgtgctaccatgcgtggctaattttctatttatatatttattttttggtagacatgaggtcttgtcatgtttcccaggtggtctttaactcctgggctcagacagtcctcccgcctcagccacccaaagtgttgggattacaggcgtgagccaccatgcgtggcataattttttttaagtaaattatttttttatcttgagtatagaagtgattcatgttcattgtggaaaatatgaaacatatagaaaaacagaaaagattacaaaacatctaatctgaaatggttaagattttgatgagaacagtctcatctcatttccgtatattcctgccagcctatccatcattcttcgtacatgtttatctacattaaaattggtgttatattttggaaactttttgtttaactacattgtgaacatttttcatgttttaaaatgtcattttaatgatggcagatcctattcaatagatgtacacacacctatttaactggtccacaattgttggatatgtaggtcgtttcctttctctctttttttttttttttggctactacttaatagtttctctgtatagaatgtggtattttgaaagtgtatcaagctttagattggtagtattcttgcatttaataaagggcagtggcctttgttgactgacatgacaatatttttataaaatttgttatttgctttacagaaattttgaaaattattgtagaaatgtttttacctcatatgaaccacctgacattggaacagactttcttttcacaagtgttaccaaaggtataatactattacctgaaaatacatgttataaggaatctagcctcagtcttagatgatttattattaattatggctctctttttctaatatatcaaatatattcaaaataaaaataaggagtaagtagatctcatgtgagactataatggtgttagtgtgatcattaggcagttaaaaactgttacaggctgggcacggtggctcatgcctgtaatcccagctctctgagaggctgaggtgggcagatcatctgaggtcaggagttcgagaccacccatggtcaacatgatgaaacctcgtctctactaaaagtacaaaaaattagctggacatggtggcaggtgcctgtaatcccagctacttgggagactgagacaggagaattgcttgagcctgggaggcggaggttgcattgagtcaagatcgtgccattgcactccagcctgggcaataagagcgatgctccgtctcaaaaaaaaaaaaaaaaaaaaaagaacttatattttcagattgtgtggttcctttactaactgaatttaaattatttgtagtcaattttaaatgctcttgtattttaaagccactgtactccagcctgggtgacagagtgaaacccttaattcaaaaaaaaaaaaaaaaaaaagaaaagctggaatattggcaaaatcaagtaactaagagaaaacattaaattcacagaatacattattacattttagatatatatggtatatgttttctctgaaaagcacaagcataccttttttgttttaaatggagggaactaaagatactttggtgccaaaatgaaacattatttgtaattaatctcttattgaaatgggtttctaactttagctttgaatcgtaatctttcaaatttcttgtactcatagtcacttgatgattctctatctgaaatatttcttagaatttgttcttgaccaccagaaaaagattcaactgttacatagatgaaaatggatgttgagtgttaacaggcctatgggaaacagtattttctttagctacattgtattgttgactgtgttgctattcttataatgtttaggtcatttaaattgttagaaagatccaagtattaagatctagggtggctaacttttcacagacaaaaagcttgtttgtaaggtcatttactatacccttaattcaggaaggttagcttgaattgggtcaaaaggaaactggttagaaaataagtgagtagtgaataggcgattcagtgcaaattccttccagaaaatacccttgtaaatgactgtatgaatgtggattcttcaagacagtcaaatttattgtgcgaaagtaatacttttattttttgcatctctaaaacatgaactttgagtgattttttaaaaaaattgatgctattaaatagattcaaaccatagaaatggaaaataaatttctgtttggggcttttggggggattatgttgtaaaaataccttttctctgtattttgtgcttaattaggtacaattgttaagctagatgatagcctgtggatgttactagtgcaaaatcaaattatcgtattgtgttttctctgtaaagttttgtcttgtcttttctagtgatttctcttattcctgtttattacttgatttgtttttacagactgtgaaattattcgatgacatgatgtatgaattaaccagtcaagccagaggactgtcaagccaaaatttggaaatccagaccactctaaggaatattttacaagtaagtcaaatgtattagaaagcaggagagagagggagcttaaagaatgtcaaaatttttatactgatactgattagctatgtattcttatgtaatggcctaatgttggaattaaatttatagaattaaagacgtgaatatagaaacatgaattctgaataataaactcttataagaagagaagtcatcaagctagctgaccctacctgtattttcaaggatatgtgtggaacacctgccatgtgttttgaagtttgtgttagtattctaaatggctagacagttgttccagtatttgtagttctgatagactaaagttctgtgaaaagaggaagagactgtgttttgttcattgctgtatttgtagcacccagcatgctgactaataccttttcagtgcacaaaaaatatattctaagtgaaatttccttccttattcacagacaatggtgcagctcttaggagctctcacaggatgtgttcagcatatctgtgccacacaggaatccatcattttggaaaatattcagagtctcccctcctcagtccttcatataattaaaagcacatttgtgcattgtaaggtgagtaaaggtctaattatactttgaatggtatataatcaatgtgcataggggctgagtaaaataatgtttgtataagattttacattttagtctatattattgaaataaacttttccatagaataaagaacatgtaagtaaataattgttgcaaaaaaagtggttttaaggaagtcattaaaagtggctttttggggttttttagttttatcttatttcccctctataaagaaagaagttttaagaatttgtgttgagacagacacagggatcctgaaatagttatgtcatgttgcattgaccaatattcaattaccattatgattagatgtcagaacttccttttataaaggaaagttaatccttatttagtccatctctacatgccagaggtagccttgaggcacaaaagcttgcctagaatttatgggtcacagacagttttaatattgctatttgttgggcgaatgaaaatcactagttaattaatacctctctttgctgataggatgctaaaaatgtcacgcacctggcctaatgttacccttttttagttctgtatttgcaagatcatggaagtcagaaataatattttatacatgcttgcatctcttgaagcacactatatttaatggatgttcactaaacaatgaatgaatatgtgattcagtaaatttatgatctctaatagtatgaattaaagtaaatttggctcttgagctttgatttgttttttctctcatttttatttatccgtaatcagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaataggtgagtgaagaaaactttctgcttagtatatggtgactataaatcatgtatcaattaaaattgtctctaatgattcatgttattttcttactaattatgcattaaaattgatttaaatcttaccaaataaatttttaatcttgaaatttggaatttgtaaaatttattttgggtaccttaacctagatttgcgtatttagttactgtaatttctccacaatgattaacttatataactttataatctctgaggttgtccatattcagagacaataactttcacatttttttaaccataactgatattgagatgcagtttatatttccttccagaatacatataaatacgtgcatatgtgtatgtaaatatgtctattctcatatacatattataatgaaataactcattttacatgtgatgcactttatactagtttatttttattttattttatttttttgagacagagtctcactgtgtagcccaggctggagtgcagtggcacaatctcggctcactgcaacctcgcctcccggactcaagcgattctcctgcctcagcctcatgagtagctgggattataggcgtccgccaccacacctggctaatttttgtatttttagtagagacagggtttcaccgtgttggccaggctggtcttgaactcctgacctcaggtaatccacctgcctcagcctcccaaagtgctgggattacaggcatgagccaccgtgcccagccaatactagtttatttttaaagaattgctggtcgtaacacacttcattgattttatcactcattaatggattatgaacaagagtttgaaaaacaatataaaggcaaagtttgcattcaaaactttggtataaagagagtaagttggttttgtgcagtgtatcaggcacctgttgctctgcaacacaccacctcaaaatctatttattcactatttatttattcatgattctgtgagtctgcagtttagggtgggatgtcctgagacaactttctctgatccacctggggcactagctcacccatgtgacttcagtgacttcattcacatctggctgttggcagaggcagaagtacttgagaaagccatgtgcatcatccagcaggttcaccctatctcagatacctgatgccagtggtttcagggtttctaagagtagcaaaagtgtgagcaggtcgctgtgtgctagcacttttcaagtttctgcttgccttaattttattattgtcccccgggccacagcaggtcatagcgtttagcccagagtcattgtagaaaagtgtggattcacaaagggcagtcattgtggccatttttataaataatctaccacagactgagtaaaagccttgcatgaataccatggatattaatttgaattcttcctttttagattttctttccttagcaatttgttttgtcattttggattagaattatatctgtagaatatttcagttataatagggtacaacttttattccactgaacatctttagttttatttaggtcatctggtaggtataaacttcagaagttaatattcaatatttataaaaaccattaacaagtgtgacacttaaatagtttaaataattcttttgacacaactgtttccaagttgtgttacgtattttaattcaatcaaatgttgaaattgttcagtagatagttttaattataggagaaactcacccccatgacatttggatgtcttaaaagttctgttatctttctttgcagttattcattctttattggatatctgctctgttatttccagtatggaccatgcatttcatgccaatacttggaagtttataattaagtaagtttgtttgttattttttactttttagaaaatgttttccatattccccaatcttaattattcatgattctttagattgcatttaaaacattttgtgtgaatttaatgttcactgacactgctgtctgataatccagatattctacatgtagctctcaagccaaattggacttctttaccctgtggcctctaaaattaaaaaaaatgttcttcctagttagctagtacttcagaaataatgggccatgggccagactagaacttaaccacttttcttctgctactgttgtttaaccagctatcaagtatcctatttctaggattagataaattgataactataattaaaactgaatataatcttttcattaggtacttttaagttgttcacacttaattccatttgtacagtaattttaactttctgaaactgaagcattttaaagggtcaccagggatagtgcctgtagcattcatcagattcttaggggtgagaggagatgtggttgagatgtaaaaatggttaagaatatctactttatacacatacataaaacattaaaggtcagtgtattttcaggtcttaggtacttttcttgtactaccaggacattaagttgccattcagtggttaagagtgttgcctgggagctgtatcacatgtgcttaaatccattcttgaaatcatttactccttctgagcccttgggctatttggttaatttctctgaacgttagtttgctcatctgaaaatggaaataataatagcaacttcttgacagggttatagtgagaattgagttcatcactgtgaaatgcttagaaatgtgcatgacacatagttaatactcaaggaattagccacatcactatcatcatcactgattatcttccactcttaccctcttccagttcattttctgcccagcagaatgatcttttaaaaagtaaatcagatcatgttactctattgcttgaagtctatcccatttgattaagaataacaacctaatcctctgtggatgctgcctccttcaccagcctgtctcatgctgctctccctactcttagttcctcaaacataccaaactctcctgtcccagagtcttttcgtggtttttccatctgcctaggatgcttctctctcctattttgtgtaccttgctaactcctgcttactgtctttcagttctcagcttaagagttatatcttcatgataacattctttgatatccttaccctaagattaagttagattgatatccttaccctaagaataagttagattaggtctctctattgtagcaccttagactctgtcatttgacaaatcacagccctaattaattattcttaaaattatttaacattctctctcatgctagaccacaagtttcatgcaggtaaggcggagattgtgtccatttgtttgacccctttgtctccagggcctggtagaatgcctcatacatagtaagaattcaattaatattttacacagagaaaaaattagcaacttatttaaacaaatataactgcttcagaggtaaactgggcacatcttagttatattatgtgatatatgatgctttttgattgtttttttaaatgttctacaaggtagatattgttagaggtcctaagttacttgatgtgttacttgtggtgattgtattcttttctttttattcatttaggcagagccttaagcaccagtccataataaaaagccagttgaaacacaaagatataattactagcttgtgtgaagacattcttttctccttccattcttgtttacagttagctgagcagatgacacagtcagatgcacaggtaaaatttgggctaatagcattttaaacagcaactcttattttctttggcagttagtaaatctcatttgaatgtctgggtcagtctatttaagaggattttaatttatttcatttgggtgtttttttttgatctgtgggattatttatatcccataattacttttcacccagagcattgtattagattcctaactgctgtcattgcctctggggtctgcctggctccctctttgcttggtaactggttggtcacagcattcttctcagaatcctttcattcttttctgcatgagaacaaaaattcttttgttcatatttgtataagatctgatatagctgcaatcaatcttgcattttttcttcaccaacgcattgcgacctttagggatacaagtatgtttgtgcatgtatatgtatgtatcagtcttttaaatttgatatagtcatacatttgtttttattttgaaaagttagagtgttgaattggtatcccatttatgaaacattatattctaaaaatttgtagtacgattattgggaattataactcattttcctgtaacactgttatacatagtaccttttgctttcagactagccctcaattttatttaactatagtagtcctaaattataagattaatagtactcaggacctaacagttatatgtcatttgttttttttttttttgagatggcgtctcactctgtcacccaagctggagtgcagtggtatgaccttggctcactgcagcctctgcctcacgggttcaagggatcgttctgccttagcctcctgagtagctgggattataggcgcctgccaccacgcctggctaatttttttagtagagacggggtttcgccatgttggccaggctggtctcgaactcctgacctcaggtggtccacccgccttggcctcccaaagtgctgggattacaggtgtgagccaccgcgcccagcctatatgtaataattttaatgggaccatgaattgaatatttcttccttgaatagcaatgacatagccccttctattgtacatctgcaagctgatacagggaattcctttgtacctgcgctcttccctgccagtcagctatgggggtgaaagtgtaggggttcatccaagtcctaaaactggtagcaactcctagggcagggctgatctggaaggacagaccctaggggagggtggaactttaaaaagaagttctgaaggtagtaagaaggaaatgaggagtagtgttaggaaggggctaacttttttcttcttgcttctcttctttatctcacctgcccctccccttgtatcccttcttcctttttccctttccttttttgtcctcacttcattcgtgcatcctttctgattcctcttaccttgctaaaaggagaagtttgtttgggtatcctatatcaatggcaggaaggttgttttcttctttacctttatcctatagattcatattctcaacaccaacctcctcctttttcagtttccttcttgcttctcttgacaccacagagtttgcagctagtacttggagaggaaaattaaacagagatacttggaccaagagtaagatgaagaaagtctaaacaacagtatagtctatagtggcaagagagagtatgggggctgcttagccagggtggctgtacataaagtatatcttcagtttatataaactgcttatagatggaaatcagaaaatttaaattctcttaactgtccaagaaaattctcattttttcaaatttgggactgataaatgtgaccagttctgcttactgtccattgcctgaaatggagctttgaggtggactgtataatttcttcaatcttaactccaaattctgatcagcgacgccctctgctgttcactattaatatttatttaccaatcaaagtaaagtattgaagttttcctggcagttttcactttgtgttttagtccatttaggctgctataacaaaatcccttaaactgggtaagggattataaatattagaaatttatctctcacagttctggaagctgggaagcccaatatcaaggcaccagtagatttggtgtctaacgagggtgtgccgtctgcttcaaaaatggccccttgttgctgcatcctcacttagtgcaaggggcaagacagctcccttcaacctcttttataagggcacttatgtcattcatgagggcagagccctcatgacttaatcacttccccaaaggccccacctcttaatagtatcacattgggtgttaggtgtctgggaggacaccaatcttcaagccatatcatctcacttggaaaaaagtcaaaataaaaccagtagatttaattaatattacactatttatagaagcatgtgatgtatcattccttgtattaatttcctggggttgccgtaacaagttaccacaaactaggtggcttaaaacaatagaattttattctctcacatttctagaggcagaagttcacagtgtgtcaatagggccatgttctctggaaggctttaggggagaatatatttcatatctttctcttagcttctcggtgtcactggcaatccttagcttactttggctttctgtgtcttcacatcatctttttataagaacaccagtgatagtgattaagggcataccttactttaatatgacctcatcttaactaattatgtcttcaataaccctatttccaaataaggccacattctgaagtattgggagttagaacttaaagctttttgggagggacacagttcaacccataacaacccctaaaatcgatatttattctcaattaagtcttgaaattggtttcaaaaagagaatattctattagagtttttaatgtatagttttaacatatagttctttagcccccaattttttttttttttttttttttttttttttttttttgagacggagtctcgctctgtcgcccaggccggactgcggactgcagtggcgcaatctcggctcactgcaagctccgcttcccgggttcacgccattcccctgcctcagcctcccgagtagctgggactacaggcgcctgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcctgcccccaattatttagtttttctataaacagggaaatttatttgtgtggcccttagaactaatttaatttccactctaattcctacttatgtttatataatgcttttagaaatttgtattattcagaaaataaacatatactattgtatctgttgcctacacttagattttattgcctgctatatttaaattttattagtattttaattgttttattaaagaaagaatgtgcctgtaatctcagcacttttgagaggccaaggcagaaggattgcttgagcccaggagtttgagaccagactgagcaacacagggagacccccatctctacaaaaaataaaaaaattctccaggcctcatggcacatacctgtagttctagttacttgggagactggggtgggaggatgcattgagcccaggagattgaggctgcagtgagccatgatcaggccactgtactccagcttggacaacagagtgagagcttgtctagatagatagatagatagataatctaaatagataatagacagattatctaaatagataatagacagattatctaaatagataatagacagattatctaaatagataatagacagattatctaaatagataatagacagattatctaaatagataatagacagattatctatctaaatagataatagattatctaaatagataatagatagatagattagatagatagatagatagatagagcttggacaacagagtgagagcctgtctagatagatagaaacaaagaaagaaagaaagaatggtgctcatattttaaagcattgaaaaatggtcttccttgcttatattacccacaccttctttgttggcattaagatgcaaactttgttttaaacagttgagtaaatcaaagatgggactgttaagttatttgtgttatttacctgctttttgaaaatgtaaaaataaaactctaggtttaattagtagtatgctatttagtaatgaagtaaagctagaggcttcgaacaaatcttgtgtaatttcctcttgaatgagagagaaaatttaaagtaagcaaacaaataagttgtgtgtcaccactcattcagtcatttaacaagtatttccagagtacttattctgtgccaggaaatgttgtaggtgccctcaacaacttagagtctagcctgagacacaagtaagtaggtaattattatagaatggtatgatctttggaggactgggtattggctggctcatgggagtacaagataggtacccagtgatgaagtcaggaaaggtttcttatggtgatatgatgacgtctatgctgattataaggtcagtgtagaataaactttgtgcttttaaatttgcatagcactgtattagagagttcatcttcaaaataatcgaaaaggctgagtgtggtgacccatggctgtaatcccagcactttgggaggccgaggtgggcagattgcttgagctaggagttcgagaccaggctggccaacatggtgaaaccccgtctctactaaaaatacaaaaattagccaggagtgatggtgcgcacctgtaatgccagctacttgggaggctgaggcaggaggatcacttgaacccaggaggtggaggttgaagtaagccgaggtcatgccactgcactccagcctgggcaacagagtgagactccatctcaaaaaaaaaaaaaatgatcaaagaaaggtgaattttcatctaccctatttctgctgaggaaaatggactattttcaaatatttttaataagggtcaaaatgagggatcgcattttttcaagttttatgatttatttaacttgtggaacaaaaataaaccagaaaccaccacctctcacgccaaagctcacaccttcagcctccaacatgaaggtctccgcagcacttctgtggctgctgctcatagcagctgccttcagcccccaggggctcgctgggccagcttctgtcccaaccacctgctgctttaacctggccaataggaagataccccttcagcgactagagagctacaggagaatcaccagtggcaaatgtccccagaaagctgtgatcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatattttttttttaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaaatgttgttttaggaatacatgaaggtctccgcagcacttctgtggctgctgctcatagcagctgccttcagcccccaggggctcgctgggccagcttctgtcccaaccacctgctgctttaacctggccaataggaagataccccttcagcgactagagagctacaggagaatcaccagtggcaaatgtccccagaaagctgtgatcttcaagaccaaactggccaaggatatctgtgccgaccccaagaagaagtgggtgcaggattccatgaagtatctggaccaaaaatctccaactccaaagccataaccacatattcccctccttttccaaggcaagatccagatggattaaaaaatgtaccaagtccctcctactagcttgcctctcttctgttctgcttgacttcctaggatctggaatctggtcagcaatcaggaatcccttcatcgtgacccccgcatgggcaaaggcttccctggaatctcccacactgtctgctccctataaaaggcaggcagatgggccagaggagcagagaggctgagaccaacccagaaaccaccacctctcacgccaaagctcacaccttcagcctccaacatgaaggtctccgcagcacttctgtggctgctgctcatagcagctgccttcagcccccaggggctcgctgggccaggtaagccccccaactccttacaggaaaggtaaggtaaccacctccaggctactaggtcagcaagaatctttacagactcactgcaaattctccatttgaaaaatagggaaacaggttttgtgggtggacaagaaatgcctcaaccgtcacatccagtcactggaagagccagaactagaaagctcccgagtcttttccccacattcaagagggccgctgggtgcatccttacccagctatccttacagtgtttgggaatggggaatggctctgtcttactgtgggcatggtgggcatttttggcagtgggagagaaggaaaatctgttgattagaagctcagtatgttaattcgactccaggacagctttcagagacagtggctaagagaagaacgaggtcccaggggatctcttgaggtgacttattttgacactctttgggaaagttatctaggagatttgttccataactcattttcccatactctggtgacaaatttactgagtgtatcggtcccactgagccagtgcatagcatggtaacaaacagttctaaattatcaatgacttaacagaattaactaaattaacaaaagttactttctcacttgtactaaatatctataatgtatgggctcaggcttctgcattttatactcaggattctagactgatggagaagttgccatgtgggggaacattgatggatactgtgataaagcagaagaaagctctcaggagtcttgcataggcaatgcactgtggctcaaaaatgacacccatcactttgtctccttctttattgatcaaaactaattaatgcctccaaccaaacaaaagtggccaagaaatgcaagtctaccttgtgtctcaaaacagaggatggagaatatttggtgaaaattaccatgaccatcacatggccacgtaggtctttataatgacagagctagcatttgtcacattgaccaagctttgtccatacactctacagtaatgatgagtcctcagtgcacaggggaggatgctgaagacacaggacagcatcctccagacacataagacttcagagcagagggattctccctccacctctcgcaattccttgctttctcctaacttcctttacaaagtcatgcttggaaatgtctatgtatcatcatgtggctcatttttttctctgttcattttttttccccaaaattcagcttctgtcccaaccacctgctgctttaacctggccaataggaagataccccttcagcgactagagagctacaggagaatcaccagtggcaaatgtccccagaaagctgtgatgtaagtaaataaagttcaccctcccctagacaaaaaaataatgtctagggcacagagtcaagaactgtgggagtcatagactctgatagtttgacctctatggtccaattcattaattttcacaagtgagtgttcactcccagctccctgcctgggagattgctgtagtcatatcaatttcttcaagtcaagagcaaagatggttttactgggcctttaagagcagcaactaacccaagagtctcatccttcctcctctccgtagcaaccctttgtccaggggcagatggtccttaaatatttagggtcaaatgggcagaattttcaaaaacaatccttccaattgcatcctgattctccccacagcttcaagaccaaactggccaaggatatctgtgccgaccccaagaagaagtgggtgcaggattccatgaagtatctggaccaaaaatctccaactccaaagccataaataatcaccatttttgaaaccaaaccagagcctgagtgttgcctaatttgttttcccttcttacaatgcattctgaggtaacctcattatcagtccaaagggcatgggttttattatatatatatatatatatttttttttaaaaaaaaacgtattgcatttaatttattgaggctttaaaacttatcctccatgaatatcagttatttttaaactgtaaagctttgtgcagattctttaccccctgggagccccaattcgatcccctgtcacgtgtgggcaatgttccccctctcctctcttcctccctggaatcttgtaaaggtcctggcaaagatgatcagtatgaaaatgtcattgttcttgtgaacccaaagtgtgactcattaaatggaagtaatgttgttttaggaatacataaagtatgtgcatattttattatagtcactagttgtaatttttttgtgggaaatccacactgagctgaggggggccaggtcgctgttggtccacgccgcccgtcgcgccgcccgcccgctcagcgtccgccgccgccatgggaggccggagccgagccggggtcgggcagcagcagggaccccccagaggcggggcctgtgggaccgctatgggcgtggagatcgagaccatctcccccggagacggaaggacattccccaagaagggccaaacgtgtgtggtgcactacacaggaatgctccaaaatgggaagaagtttgattcatccagagacagaaacaaacctttcaagttcagaattggcaaacaggaagtcatcaaaggttttgaagagggtgcagcccagatgagcttggggcagagggcgaagctgacctgcacccctgatgtggcatatggagccacgggccaccccggtgtcatccctcccaatgccaccctcatctttgacgtggagctgctcaacttagagtgaaggcaggaaggaactcaaggtggctggagatggctgctgctcaccctcctagcctgctctgccactgggacggctcctgcttttggggctcttgatcagtgtgctaacctcactgcctcatggcatcatccattctctctgcccaagttgctctgtatgtgttcgtcagtgttcatgcgaattcttgcttgaggaaacttcggttgcagattgaagcatttcaggttgtgcattttgtgtgatgcatgtagtagcctttcctgatgacagaacacagatctcttgttcgcacaatctacactgccttaccttcacttaaaccacacacacaaggtgctcagacatgaaatgtacatggcgtaccgtacacagagggacttgagccagttacctttgctgtcactttctctcttataaattctgttagctgctcacttaaacaatgtcctctttgagaaaatgtaaaataaaggctctgtgcttgacagaattcgggccgccgccaggtcgctgttggtccacgccgcccgtcgcgccgcccgcccgctcagcgtccgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccatggagggatctggtgcctccagacatgtgcacatgagtccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcattttattttgttttcattttggggtgaagattcagtttcagtcttttggatataggtttccaattaagtacatggtcaagtattaacagcacaagtggtaggttaacattagaataggaattggtgttggggggggggtttgcaagaatattttattttaattttttggatgaaatttttatctattatatattaaacattcttgctgctgcgctgcaaagccatagcagatttgaggcgctgttgaggactgaattactctccaagttgagagatgtctttgggttaaattaaaagccctacctaaaactgaggtggggatggggagagcctttgcctccaccattcccacccaccctccccttaaaccctctgcctttgaaagtagatcatgttcactgcaatgctggacactacaggtatctgtccctgggccagcagggacctctgaagccttctttgtggccttttttttttttcatcctgtggtttttctaatggactttcaggaattttgtaatctcataactttccaagctccaccacttcctaaatcttaagaactttaattgacagtttcaattgaaggtgctgtttgtagacttaacacccagtgaaagcccagccatcatgacaaatccttgaatgttctcttaagaaaatgatgctggtcatcgcagcttcagcatctcctgttttttgatgcttggctccctctgctgatctcagtttcctggcttttcctccctcagccccttctcacccctttgctgtcctgtgtagtgatttggtgagaaatcgttgctgcacccttcccccagcaccatttatgagtctcaagttttattattgcaataaaagtgctttatgcccgaattcgccgccgccatgggagtgcaggtggaaaccatctccccaggagacgggcgcaccttccccaagcgcggccagacctgcgtggtgcactacaccgggatgcttgaagatggaaagaaatttgattcctcccgggacagaaacaagccctttaagtttatgctaggcaagcaggaggtgatccgaggctgggaagaaggggttgcccagatgagtgtgggtcagagagccaaactgactatatctccagattatgcctatggtgccactgggcacccaggcatcatcccaccacatgccactctcgtcttcgatgtggagcttctaaaactggaatgacaggaatggcctcctcccttagctccctgttcttggatctgccrtggagggatctggtgcctccagacatgtgcacatgartccatatggagcttttcctgatgttccactccactttgtatagacatctgccctgactgaatgtgttctgtcactcagctttgcttccgacacctctgtttcctcttcccctttctcctcgtatgtgtgtttacctaaactatatgccataaacctcaagttattcaaagcttctaccctagtctggtgctacacttacattgcttacatccaagtgtggttatttctgtggctcctgttataactattatagcaccaggtctatgaccaggagaattagactggcattaaatcagaataagagattttgcacctgcaatagaccttatgacacctaaccaaccccattatttacaattaaacaggaacagagggaatactttatccaactcacacaagctgttttcctcccagatccatgcttttttgcgtttattattttttagagatgggggcttcactatgttgcccacactggactaaaactctgggcctcaagtgattgtcctgcctcagcctcctgaatagctgggactacaggggcatgccatcacacctagttcatttcctctatttaaaatatacatggcttaaactccaactgggaacccaaaacattcatttgctaagagtctggtgttctaccacctgaactaggctggccacaggaattataaaagctgagaaattctttaataatagtaaccaggcaacatcattgaaggctcatatgtaaaaatccatgccttcctttctcccaatctccattcccaaacttagccactggttctggctgaggccttacgcatacctcccggggcttgcacacaccttcttctacagaagacacaccttgggcatatcctacagaagaccaggcttctctctggtccttggtagagggctactttactgtaacagggccagggtggagagttctctcctgaagctccatcccctctataggaaatgtgttgacaatattcagaagagtaagaggatcaagacttctttgtgctcaaataccactgttctcttctctaccctgccctaaccaggagcttgtcaccccaaactctgaggtgatttatgccttaatcaagcaaacttccctcttcagaaaagatggctcattttccctcaaaagttgccaggagctgccaagtattctgccaattcaccctggagcacaatcaacaaattcagccagaacacaactacagctactattagaactattattattaataaattcctctccaaatctagccccttgacttcggatttcacgatttctcccttcctcctagaaacttgataagtttcccgcgcttccctttttctaagactacatgtttgtcatcttataaagcaaaggggtgaataaatgaaccaaatcaataacttctggaatatctgcaaacaacaataatatcagctatgccatctttcactattttagccagtatcgagttgaatgaacatagaaaaatacaaaactgaattcttccctgtaaattccccgttttgacgacgcacttgtagccacgtagccacgcctacttaagacaattacaaaaggcgaagaagactgactcaggcttaagctgccagccagagagggagtcatttcattggcgtttgagtcagcaaaggtattgtcctcacatctctggctattaaagtattttctgttgttgtttttctctttggctgttttctctcacattgccttctctaaagctacagtctctcctttcttttcttgtccctccctggtttggtatgtgacctagaattacagtcagatttcagaaaatgattctctcattttgctgataaggactgattcgttttactgagggacggcagaactagtttcctatgagggcatgggtgaatacaactgaggcttctcatgggagggaatctctactatccaaaattattaggagaaaattgaaaatttccaactctgtctctctcttacctctgtgtaaggcaaataccttattcttgtggtgtttttgtaacctcttcaaactttcattgattgaatgcctgttctggcaatacattaggttgggcacataaggaataccaacataaataaaacattctaaaagaagtttacgatctaataaaggagacaggtacatagcaaactaattcaaaggagctagaagatggagaaaatgctgaatgtggactaagtcattcaacaaagttttcaggaagcacaaagaggaggggctcccctcacagatatctggattagaggctggctgagctgatggtggctggtgttctctgttgcagaagtcaagatggccaaagttccagacatgtttgaagacctgaagaactgttacaggtaaggaataagatttatctcttgtgatttaatgagggtttcaaggctcaccagaatccagctaggcataacagtggccagcatgggggcaggccggcagaggttgtagagatgtgtactagtcctgaagtcagagcaggttcagagaagacccagaaaaactaagcattcagcatgttaaactgagattacattggcagggagaccgccattttagaaaaattatttttgaggtctgctgagccctacatgaatatcagcatcaacttagacacagcctctgttgagatcacatgccctgatataagaatgggttttactggtccattctcaggaaaacttgatctcattcaggaacaggaaatggctccacagcaagctgggcatgtgaactcacatatgcaggcaaatctcactcagatgtagaagaaaggtaaatgaacacaaagataaaattacggaacatattaaactaacatgatgtttccattatctgtagtaaatactaacacaaactaggctgtcaaaattttgcctggatattttactaagtataaattatgaaatctgttttagtgaatacatgaaagtaatgtgtaacatataatctatttggttaaaataaaaaggaagtgcttcaaaacctttcttttctctaaaggagcttaacattcttccctgaacttcaattaaagctcttcaatttgttagccaagtccaatttttacagataaagcacaggtaaagctcaaagcctgtcttgatgactactaattccagattagtaagatatgaattactctacctatgtgtatgtgtagaagtccttaaatttcaaagatgacagtaatggccatgtgtatgtgtgtgacccacaactatcatggtcattaaagtacattggccagagaccacatgaaataacaacaattacattctcatcatcttattttgacagtgaaaatgaagaagacagttcctccattgatcatctgtctctgaatcaggtaagcaaatgactgtaattctcatgggactgctattcttacacagtggtttcttcatccaaagagaacagcaatgacttgaatcttaaatacttttgttttaccctcactagagatccagagacctgtctttcattataagtgagaccagctgcctctctaaactaatagttgatgtgcattggcttctcccagaacagagcagaactatcccaaatccctgagaactggagtctcctggggcaggcttcatcaggatgttagttatgccatcctgagaaagccccgcaggccgcttcaccaggtgtctgtctcctaacgtgatgtgttgtggttgtcttctctgacaccagcatcagaggttagagaaagtctccaaacatgaagctgagagagaggaagcaagccagctgaaagtgagaagtctacagccactcatcaatctgtgttattgtgtttggagaccacaaatagacactataagtactgcctagtatgtcttcagtactggctttaaaagctgtccccaaaggagtatttctaaaatattttgagcattgttaagcagatttttaacctcctgagagggaactaattggaaagctaccactcactacaatcattgttaacctatttagttacaacatctcatttttgagcatgcaaataaatgaaaaagtcttcctaaaaaaatcatctttttatcctggaaggaggaaggaaggtgagacaaaagggagagagggagggaagcctaatgaaacaccagttacctaagaccagaatggagatcctcctcactacctctgttgaatacagcacctactgaaagaactttcattccctgaccatgaacagcctctcagcttctgttttccttcctcacagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaaggtaaggggtcaagcacaataatatctttcttttacagttttaagcaagtagggacagtagaatttaggggaaaattaaacgtggagtcagaataacaagaagacaaccaagcattagtctggtaactatacagaggaaaattaatttttatccttctccaggagggagaaatgagcagtggcctgaatcgagaatacttgctcacagccattatttcttagccatattgtaaaggtcgtgtgacttttagcctttcaggagaaagcagtaataagaccacttacgagctatgttcctctcatactaactatgcctccttggtcatgttacataatcttttcgtgattcagtttcctctactgtaaaatggagataatcagaatcccccactcattggattgttgtaaagattaagagtctcaggctttacagactgagctagctgggccctcctgactgttataaagattaaatgagtcaacatcccctaacttctggactagaataatgtctggtacaaagtaagcacccaataaatgttagctattactatcattattattattattttattttttttttttgagatggagtctggctctgtcacccaggctggagtgcagtggcacaatctcggctcactgcaagctctgcctcctgggttcatgccattctcctgcctcagcctcccgagtaagctgggaatacaggcacccgccactgttcccggctaattttttgtatttttagtagagacggagtttcaccgtggtctccatctcctcgtgatccacccaccttggcctcccaaagtgccgggattacaggcgtgagccaccgcgcccggcctattattattattattactactactactacctatatgaatactaccagcaatactaatttattaatgactggattatgtctaaacctcacaagaatcctaccttctcattttacataaaaggaaactaagctcattgagataggtaaactgcccaatggcatacatctgtaagtgggagagcctcaaatctaattcagttctacctgagtaaaaaaatcatggtttctcctccatccctttactgtacaagcctccacatgaactataaacccaatattcctgtttttaagataatacctaagcaataacgcatgttcacctagaaggttttaaaatgtaacaaaatataagaaaataaaaatcactcatatcgtcagtgagagtttactactgccagcactatggtatgtttccttaaaatctttgctatacacatacctacatgtgaacaaatatgtctaacatcaagaccacactatttacaactttatatccagcttttcttacttagcaatgtattgaggacattttagagtgcccgtttttcaccattataagcaatgcaacaatgaacatctgtataaataaatattcatttctctcaccctttatttccttagaatatattcctagaagtagaatttcccagagccatgaggatttgtgacgctattgatatgtgccactttgcactctctgtgacatatataattatttttaatgcattcatttttttctcagagtgcattcgtttgaaaacatagacgggaaatactggtagtcttccttgtcagttagaaacacccaaacaatgaaaaatgaaaaagttgcacaaatagtctctaaaaacaatgaaactattgcctgaggaattgaagtttaaaaagaagcacataagcaacaacaaggataatcctagaaaaccagttctgctgactgggtgatttcacttctctttgcttcctcatctggattggaatattcctaataccccctccagaactattttccctgtttgtactagactgtgtatatcatctgtgtttgtacatagacattaatctgcacttgtgatcatggttttagaaatcatcaagcctaggtcatcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcaggtacattaaaatggcaccagacatttctgtcatcctcccctcctttcatttacttatttatttatttcaatctttctgcttgcaaaaaacatacctcttcagagttctgggttgcacaattcttccagaatagcttgaagcacagcacccccataaaaatcccaagccagggcagaaggttcaactaaatctggaagttccacaagagagaagtttcctatctttgagagtaaagggttgtgcacaaagctagctgatgtactacctctttggttctttcagacattcttaccctcaattttaaaactgaggaaactgtcagacatattaaatgatttactcagatttacccagaagccaatgaagaacaatcactctcctttaaaaagtctgttgatcaaactcacaagtaacaccaaaccaggaagatctttattatctctgataacatatttgtgaggcaaaacctccaataagctacaaatatggcttaaaggatgaagtttagtgtccaaaaacttttatcacacacatccaattttcatggcggacatgttttagtttcaacagtatacatattttcaaaggtccagagaggcaattttgcaataaacaagcaagactttttctgattggatgcacttcagctaacatgctttcaactctacatttacaaattattttgtgttctatttttctacttaatattatttctgcaattttcccaatattgacatcgtgtatgtatttgccatttttaatatcactagacaattcaatcaggttgctacgttggtcccttgggtttactctaaatagcttgattgcaaatatctttgtatatattattgttttttctcctatcttgtaatttctttgagcacatcccaaagaggaatgcctagatcaatgggcacaaataatttgacagctcttattaaacattattctgtaagtaaaaactgaactacttttcagtatcactagcaacatatgagtgtatcagcttcctaaacccctccatgttaggtcattatgaacttatgatctaacaaattacagggtcttatcccactaatgaaattataagagattcaacacttattcagccccgaaggattcattcaacgtagaaaattctaagaacattaaccaagtatttacctgcctagtgagtgtggaagacattgtgaaggacacaaagatgtatagaattccattcctgacttccaggtatttacaccataggtggggacctaactacacacacacacacacacacacacacacacacacacaccatgcacacacaatctacatcaacacttgattttatacaaatacaatgaatttactttctttttggttcttctcttcaccagtgaaatttgacatgggtgcttataagtcatcaaaggatgatgctaaaattaccgtgattctaagaatctcaaaaactcaattgtatgtgactgcccaagatgaagaccaaccagtgctgctgaaggtcagttgtcctttgtctccaacttaccttcatttacatctcatatgtttgtaaataagcccaataggcagacacctctaacaaggtgacactgtcctctttccttcctaccacagcccccacctacccaccccactcccattgattccagaggcgtgcctaggcaggatctatgagaaaatataacagagagtaagaggaaaattaccttctttctttttcctttccctgcctgaccttattcacctcccatcccagagcatccatttattccattgatctttactgacatctattatctgacctacacaatactagacattaggacaatgtggcctgcctccaagaaactcaaataagccaactgagatcagagaggattaatcacctgccaatgggcacaaagcaacaagctgggagccaagtcccaaaatggggcctgctgcttccagttcccctctctctgcattgatgtcagcattatccttcgtcccagtcctgtctccactaccactttccccctcaaacacacacacacacaacagccttagatgttttctccactgataagtaggtgactcaatttgtaagtatataatccaagaccttctattcccaagtagaatttatgtgcctgcctgtgcttttctacctggatcaagtgatgtctacagagtagggcagtagcttcattcatgaactcattcaacaagcattattcactgagagccttgtatttttcaggcatagtgccaacagcagtgtggacagtggtgcatcaaagcctctagtctcatagaacttagtcttctggaggatatggaaaacagacaacccaaacaaccaacaaaagagcaagatgctgcaaaaaaaaaaaaaatgaatagggtgctaagatagagaaaagtgggagagtgctatttagacaaagtggtaaaaacaaagccccttgtgagatgagagctgccgacagagggggcgggtcatggttgtgggtttttgggtaggacattcagaggagggggcgggtcgtggttgtgggtttttgggtaggacattcagaggagggggcgggtcgtggttgtgggtttttgggtaggacattcagaggagggggcgggtcgtggttgtgggtttttgggtaggacattcagaggagggggcgggtcgtggttgtgggtttttgggacattcagaggagtctgaatgcacccaggcctacaacttcaagatggtaaaggacagctccaaggatcagaagaagcattcttggaactggggcattttgagaaggaggaaaaatatgcagagactagtgcttgcagagcttgcatttggatttcatttgaggtacaatgaaaacccattaatgggtttcacacagtgcaatggcctgacctcacttatatttcctaaaatagaaaacagatcagaaggaaggcaatagagaagcagaaagtccaatgaggaggtttcacagcagtcatgggggtggggtaaggaaaagaagtggaaagaaacagacagaattgggttatattttggagatagaaccaacagaaggaagaggagaaacaacatttactgagaagggaaaaagtaggagaggaataggtttgggaaataaatcctgctgacattggaaaccccaaggaagcctcaaaagtatatttacttgctttagatttaaaagaataggaaagaagcatctcaacttggaatttgaaatctatttttccataaaagtattgttaaattctactcatactcacaagaaaagtacattctaaagagtatattgaaagagtttactgatatacttaggaattttgtgtgtatgtgtgtgtgtgtatgtgtgtgtgtgtgtttaaccttcaattgttgacttaaatactgagataaatgtcatctaaatgctaaattgatttcccaaaggtatgatttgttcacttggagatcaaaatgtttagggggcttagaatcactgtagtgctcagatttgatgcaaaatgtcttaggcctatgttgaaggcaggacagaaacaatgtttccctcctacctgcctggatacagtaagatactagtgtcactgacaatcttcataactaatttagatctctctccaatcaactaaggaaatcaactcttattaatagactgggccacacatctactaggcatgtaataaatgcttgctgaatgaacaaatgaatgaagagcctatagcatcatgttacagccatagtcctaaagtggtgtttctcatgaaggccaaatgctaagggattgagcttcagtcctttttctaacatcttgttctctaacagaattctcttcttttcttcataggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctgcttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttctcgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcattcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaacaaaattctctgacacatagttattcattgccttaatcattattttactgcatggtaattagggacaaatggtaaatgtttacataaataattgtatttagtgttactttataaaatcaaaccaagattttatatttttttctcctctttgttagctgccagtatgcataaatggcattaagaatgataatatttccgggttcacttaaagctcatattacacatacacaaaacatgtgttcccatctttatacaaactcacacatacagagctacattaaaaacaactaataggccaggcacggtggctcagacctgtaatcccagcactttgggaggaccaacctcttcgaggcacaaggcacaacaggctgctctgggattctcttcagccaatcttcattgctcaagtgtctgaagcagccatggcagaagtacctgagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttctctgaagagaaagaaagagagagagaaagaaaagaaagaggaaggaaggaaggaaggaagaaagacaggctctgaggaaggtggcagttcctacaacgggagaaccagtggttaatttgcaaagtggatcctgtggaggcanncagaggagtcccctaggccacccagacagggcttttagctatctgcaggccagacaccaaatttcaggagggctcagtgttaggaatggattatggcttatcaaattcacaggaaactaacatgttgaacagcttttagatttcctgtggaaaatataacttactaaagatggagttcttgtgactgactcctgatatcaagatactgggagccaaattaaaaatcagaaggctgcttggagagcaagtccatgaaatgctctttttcccacagtagaacctatttccctcgtgtctcaaatacttgcacagaggctcactcccttggataatgcagagcgagcacgatacctggcacatactaatttgaataaaatgctgtcaaattcccattcacccattcaagcagcaaactctatctcacctgaatgtacatgccaggcactgtgctagacttggctcaaaaagatttcagtttcctggaggaaccaggagggcaaggtttcaactcagtgctataagaagtgttacaggctggacacggtggctcacgcctgtaatcccaacatttgggaggccgaggcgggcagatcacaaggtcaggagatcgagaccatcctggctaacatggtgaaaccctgtctctactaaaaatacaaaaaattagccgggcgttggcggcaggtgcctgtagtcccagctgctggggaggctgaggcaggagaatggtgtgaacccgggaggcggaacttgcagggggccgagatcgtgccactgcactccagcctgggcgacagagtgagactctgtctcaaaaaaaaaaaaaaagtgttatgatgcagacctgtcaaagaggcaaaggagggtgttcctacactccaggcactgttcataacctggactctcattcattctacaaatggagggctcccctgggcagatccctggagcaggcactttgctggtgtctcggttaaagagaaactgataactcttggtattaccaagagatagagtctcagatggatattcttacagaaacaatattcccacttttcagagttcaccaaaaaatcattttaggcagagctcatctggcattgatctggttcatccatgagattggctagggtaacagcacctggtcttgcagggttgtgtgagcttatctccagggttgccccaactccgtcaggagcctgaaccctgcataccgtatgttctctgccccagccaagaaaggtcaattttctcctcagaggctcctgcaattgacagagagctcccgaggcagagaacagcacccaaggtagagacccacaccctcaatacagacagggagggctattggcccttcattgtacccatttatccatctgtaagtgggaagattcctaaacttaagtacaaagaagtgaatgaagaaaagtatgtgcatgtataaatctgtgtgtcttccactttgtcccacatatactaaatttaaacattcttctaacgtgggaaaatccagtattttaatgtggacatcaactgcacaacgattgtcaggaaaacaatgcatatttgcatggtgatacatttgcaaaatgtgtcatagtttgctactccttgcccttccatgaaccagagaattatctcagtttattagtcccctcccctaagaagcttccaccaatactcttttcccctttcctttaacttgattgtgaaatcaggtattcaacagagaaatttctcagcctcctacttctgcttttgaaagctataaaaacagcgagggagaaactggcagataccaaacctcttcgaggcacaaggcacaacaggctgctctgggattctcttcagccaatcttcattgctcaagtatgactttaatcttccttacaactaggtgctaagggagtctctctgtctctctgcctctttgtgtgtatgcatattctctctctctctctctttctttctctgtctctcctctccttcctctctgcctcctctctcagctttttgcaaaaatgccaggtgtaatataatgcttatgactcgggaaatattctgggaatggatactgcttatctaacagctgacaccctaaaggttagtgtcaaagcctctgctccagctctcctagccaatacattgctagttggggtttggtttagcaaatgcttttctctagacccaaaggacttctctttcacacattcattcatttactcagagatcatttctttgcatgactgccatgcactggatgctgagagaaatcacacatgaacgtagccgtcatggggaagtcactcattttctcctttttacacaggtgtctgaagcagccatggcagaagtacctgagctcgccagtgaaatgatggcttattacaggtcagtggagacgctgagaccagtaacatgagcaggtctcctctttcaagagtagagtgttatctgtgcttggagaccagatttttcccctaaattgcctctttcagtggcaaacagggtgccaagtaaatctgatttaaagactactttcccattacaagtccctccagccttgggacctggaggctatccagatgtgttgttgcaagggcttcctgcagaggcaaatggggagaaaagattccaagcccacaatacaaggaatccctttgcaaagtgtggcttggagggagagggagagctcagattttagctgactctgctgggctagaggttaggcctcaagatccaacagggagcaccagggtgcccacctgccaggcctagaatctgccttctggactgttctgcgcatatcactgtgaaacttgccaggtgtttcaggcagctttgagaggcaggctgtttgcagtttcttatgaacagtcaagtcttgtacacagggaaggaaaaataaacctgtttagaagacataattgagacatgtccctgtttttattacagtggcaatgaggatgacttgttctttgaagctgatggccctaaacagatgaaggtaagactatgggtttaactcccaacccaaggaagggctctaacacagggaaagctcaaagaagggagttctgggccactttgatgccatggtattttgttttagaaagactttaacctcttccagtgagacacaggctgcaccacttgctgacctggccacttggtcatcatatcaccacagtcactcactaacgttggtggtggtggccacacttggtggtgacaggggaggagtagtgataatgttcccatttcatagtaggaagacaaccaagtcttcaacataaatttgattatccttttaagagatggattcagcctatgccaatcacttgagttaaactctgaaaccaagagatgatcttgagaactaacatatgtctaccccttttgagtagaatagttttttgctacctggggtgaagcttataacaacaagacatagatgatataaacaaaaagatgaattgagacttgaaagaaaaccattcacttgctgtttgaccttgacaagtcattttacccgctttggacctcatctgaaaaataaagggctgagctggatgatctctgagattccagcatcctgcaacctccagttctgaaatattttcagttgtagctaagggcatttgggcagcaaatggtcatttttcagactcatccttacaaagagccatgttatattcctgctgtcccttctgttttatatgatgctcagtagccttcctaggtgcccagccatcagcctagctaggtcagttgtgcaggttggaggcagccacttttctctggctttattttattccagtttgtgatagcctcccctagcctcataatccagtcctcaatcttgttaaaaacatatttctttagaagttttaagactggcataacttcttggctgcagctgtgggaggagcccattggcttgtctgcctggcctttgccccccattgcctcttccagcagcttggctctgctccaggcaggaaattctctcctgctcaactttcttttgtgcacttacaggtctctttaactgtctttcaagcctttgaaccattatcagccttaaggcaacctcagtgaagccttaatacggagcttctctgaataagaggaaagtggtaacatttcacaaaaagtactctcacaggatttgcagaatgcctatgagacagtgttatgaaaaaggaaaaaaaagaacagtgtagaaaaattgaatacttgctgagtgagcataggtgaatggaaaatgttatggtcatctgcatgaaaaagcaaatcatagtgtgacagcattagggatacaaaaagatatagagaaggtatacatgtatggtgtaggtggggcatgtacaaaaagatgacaagtagaatcgggatttattctaaagaatagcctgtaaggtgtccagaagccacattctagtcttgagtctgcctctacctgctgtgtgcccttgagtacacccttaacctccttgagcttcagagagggataatctttttattttattttattttattttgttttgttttgttttgttttgttttatgagacagagtctcactctgttgcccaggctggagtgcagtggtacaatcttggcttactgcatcctccacctcctgagttcaagcgattctccttcctcagtctcctgaatagctaggattacaggtgcaccccaccacacccagctaatttttgtatttttagtagagaaggggtttcgccatgttggccaggctggttttgaagtcctgacctaaatgattcatccacctcggcttcccaaagtgctgggattacaggcatgagccaccacgcctggcccagagagggatgatctttagaagctcgggattctttcaagccctttcctcctctctgagctttctactctctgatgtcaaagcatggttcctggcaggaccacctcaccaggctccctccctcgctctctccgcagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaaggtagttagccaagagcaggcagtagatctccacttgtgtcctcttggaagtcatcaagccccagccaactcaattcccccagagccaaagccctttaaaggtagaaggcccagcggggagacaaaacaaagaaggctggaaaccaaagcaatcatctctttagtggaaactattcttaaagaagatcttgatggctactgacatttgcaactccctcactctttctcaggggcctttcacttacattgtcaccagaggttcgtaacctccctgtgggctagtgttatgaccatcaccattttacctaagtagctctgttgctcggccacagtgagcagtaatagacctgaagctggaacccatgtctaatagtgtcaggtccagtgttcttagccaccccactcccagcttcatccctactggtgttgtcatcagactttgaccgtatatgctcaggtgtcctccaagaaatcaaattttgccacctcgcctcacgaggcctgcccttctgattttatacctaaacaacatgtgctccacatttcagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaaggtaaatggaaacatcctggtttccctgcctggcctcctggcagcttgctaattctccatgttttaaacaaagtagaaagttaatttaaggcaaatgatcaacacaagtgaaaaaaaatattaaaaaggaatatacaaactttggtcctagaaatggcacatttgattgcactggccagtgcatttgttaacaggagtgtgaccctgagaaattagacggctcaagcactcccaggaccatgtccacccaagtctcttgggcatagtgcagtgtcaattcttccacaatatggggtcatttgatggacatggcctaactgcctgtgggttctctcttcctgttgttgaggctgaaacaagagtgctggagcgataatgtgtccatccccctccccagtcttccccccttgccccaacatccgtcccacccaatgccaggtggttccttgtagggaaattttaccgcccagcaggaacttatatctctccgctgtaacgggcaaaagtttcaagtgcggtgaacccatcattagctgtggtgatctgcctggcatcgtgccacagtagccaaagcctctgcacaggagtgtgggcaactaaggctgctgactttgaaggacagcctcactcagggggaagctatttgctctcagccaggccaagaaaatcctgtttctttggaatcgggtagtaagagtgatcccagggcctccaattgacactgctgtgactgaggaagatcaaaatgagtgtctctctttggagccactttcccagctcagcctctcctctcccagtttcttcccatgggctactctctgttcctgaaacagttctggtgcctgatttctggcagaagtacagcttcacctctttcctttccttccacattgatcaagttgttccgctcctgtggatgggcacattgccagccagtgacacaatggcttccttccttccttccttcagcatttaaaatgtagaccctctttcattctccgttcctactgctatgaggctctgagaaaccctcaggcctttgaggggaaaccctaaatcaacaaaatgaccctgctattgtctgtgagaagtcaagttatcctgtgtcttaggccaaggaacctcactgtgggttcccacagaggctaccaattacatgtatcctactctcggggctaggggttggggtgaccctgcatgctgtgtccctaaccacaagacccccttctttcttcagtggtgttctccatgtcctttgtacaaggagaagaaagtaatgacaaaatacctgtggccttgggcctcaaggaaaagaatctgtacctgtcctgcgtgttgaaagatgataagcccactctacagctggaggtaagtgaatgctatggaatgaagcccttctcagcctcctgctaccacttattcccagacaattcaccttctccccgcccccatccctaggaaaagctgggaacaggtctatttgacaagttttgcattaatgtaaataaatttaacataatttttaactgcgtgcaaccttcaatcctgctgcagaaaattaaatcattttgccgatgttattatgtcctaccatagttacaaccccaacagattatatattgttagggctgctctcatttgatagacaccttgggaaatagatgacttaaagggtcccattatcacgtccactccactcccaaaatcaccaccactatcacctccagctttctcagcaaaagcttcatttccaagttgatgtcattctaggaccataaggaaaaatacaataaaaagcccctggaaactaggtacttcaagaagctctagcttaattttcacccccccaaaaaaaaaaaattctcacctacattatgctcctcagcatttggcactaagttttagaaaagaagaagggctcttttaataatcacacagaaagttgggggcccagttacaactcaggagtctggctcctgatcatgtgacctgctcgtcagtttcctttctggccaacccaaagaacatctttcccataggcatctttgtcccttgccccacaaaaattcttctttctctttcgctgcagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatccccagcccttttgttgagccaggcctctctcacctctcctactcacttaaagcccgcctgacagaaaccacggccacatttggttctaagaaaccctctgtcattcgctcccacattctgatgagcaaccgcttccctatttatttatttatttgtttgtttgttttgattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctgaaataaacttcactgaagaaaaaaaaaaaagggtctctcctgatcattgactgtctggattgacactgacagtaagcaaacaggctgtgagagttcttgggactaagcccactcctcattgctgagtgctgcaagtacctagaaatatccttggccaccgaagactatcctcctcacccatcccctttatttcgttgttcaacagaaggatattcagtgcacatctggaacaggatcagctgaagcactgcagggagtcaggactggtagtaacagctaccatgatttatctatcaatgcaccaaacatctgttgagcaagcgctatgtactaggagctgggagtacagagatgagaacagtcacaagtccctcctcagataggagaggcagctagttataagcagaacaaggtaacatgacaagtagagtaagatagaagaacgaagaggagtagccaggaaggagggaggagaacgacataagaatcaagcctaaagggataaacagaagatttccacacatgggctgggccaattgggtgtcggttacgcctgtaatcccagcactttgggtggcaggggcagaaagatcgcttgagcccaggagttcaagaccagcctgggcaacatagtgagactcccatctctacaaaaaataaataaataaataaaacaatcagccaggcatgctggcatgcacctgtagtcctagctacttgggaagctgacactggaggattgcttgagcccagaagttcaagactgcagtgagcttatccgttgacctgcaggtcgacacaaaccttttcgaggcaaaaggcaaaaaaggctgctctgggattctcttcagccaatcttcaatgctcaagtgtctgaagcagccatggcagaagtacctaagctcgccagtgaaatgatggcttattacagtggcaatgaggatgacttgttctttgaagctgatggccctaaacagatgaagtgctccttccaggacctggacctctgccctctggatggcggcatccagctacgaatctccgaccaccactacagcaagggcttcaggcaggccgcgtcagttgttgtggccatggacaagctgaggaagatgctggttccctgcccacagaccttccaggagaatgacctgagcaccttctttcccttcatctttgaagaagaacctatcttcttcgacacatgggataacgaggcttatgtgcacgatgcacctgtacgatcactgaactgcacgctccgggactcacagcaaaaaagcttggtgatgtctggtccatatgaactgaaagctctccacctccagggacaggatatggagcaacaagtggtgttctccatgtcctttgtacaaggagaagaaagtaatgacaaaatacctgtggccttgggcctcaaggaaaagaatctgtacctgtcctgcgtgttgaaagatgataagcccactctacagctggagagtgtagatcccaaaaattacccaaagaagaagatggaaaagcgatttgtcttcaacaagatagaaatcaataacaagctggaatttgagtctgcccagttccccaactggtacatcagcacctctcaagcagaaaacatgcccgtcttcctgggagggaccaaaggcggccaggatataactgacttcaccatgcaatttgtgtcttcctaaagagagctgtacccagagagtcctgtgctgaatgtggactcaatccctagggctggcagaaagggaacagaaaggtttttgagtacggctatagcctggactttcctgttgtctacaccaatgcccaactgcctgccttagggtagtgctaagaggatctcctgtccatcagccaggacagtcagctctctcctttcagggccaatcccagcccttttgttgagccaggcctctctcacctctcctactcacttaaagcccgcctgacagaaaccaggccacattttggttctaagaaaccctcctctgtcattcgctcccacattctgatgagcaaccgcttccctatttatttatttatttgtttgtttgttttgattcattggtctaatttattcaaagggggcaagaagtagcagtgtctgtaaaagagcctagtttttaatagctatggaatcaattcaatttggactggtgtgctctctttaaatcaagtcctttaattaagactgaaaatatataagctcagattatttaaatgggaatatttataaatgagcaaatatcatactgttcaatggttctcaaataaacttcactctggcaggagtagcagctgccccttggcgcgactgctggagccgcgaactagagaaacacagacacgcctcatagagcaacggcgtctctcggagcgtggagcccgccaagctcgagctgagctttcgcttgccgtccaccactgcccacactgtcgtttgctgccatcgcagacctgctgctgacttccatccctctggatccggcaagggcctgcgattttgacaatgtcaagatttaccgtatatccctgtttgtttggatacaccagtgacgtccacttctagaagacaaagttatattacttaaacaaccaaagatatgaaactatccatgaagaacaatattatcaatacacagcagtcttttgtaaccatgcccaatgtgattgtaccagatattgaaaaggaaatacgaaggatggaaaatggagcatgcagctccttttctgaggatgatgacagtgcctctacatctgaagaatcagagaatgaaaaccctcatgcaaggggttcctttagttataagtcactcagaaagggaggaccatcacagagggagcagtacctgcctggtgccattgccatttttaatgtgaacaacagcgacaataaggaccaggaaccagaagaaaaaaagaaaaagaaaaaagaaaagaagagcaagtcagatgataaaaacgaaaataaaaacgacccaaagaagaagatggaaaagcgaatggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcagcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagttgaaacaagaagccacagacctaggatttcatgatttcatttcaactgtttgccttctgcttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttctcgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcattcaattccacctgcaatcaagtcctacaagctaaaattagatgaactcaactttgacaaccatagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaagtgagggagtcatttcattggcgtttgagtcagcaaagaagtcaagagctgccagccagagagggagtcatttcattggcgtttgagtcagcaaagaagtcaagatggccaaagttccagacatgtttgaagacctgaagaactgttacagtgaaaatgaagaagacagttcctccattgatcatctgtctctgaatcagaaatccttctatcatgtaagctatggcccactccatgaaggctgcatggatcaatctgtgtctctgagtatctctgaaacctctaaaacatccaagcttaccttcaaggagagcatggtggtagtagcaaccaacgggaaggttctgaagaagagacggttgagtttaagccaatccatcactgatgatgacctggaggccatcgccaatgactcagaggaagaaatcatcaagcctaggtcatcaccttttagcttcctgagcaatgtgaaatacaactttatgaggatcatcaaatacgaattcatcctgaatgacgccctcaatcaaagtataattcgagccaatgatcagtacctcacggctgctgcattacataatctggatgaagcagtgaaatttgacatgggtgcttataagtcatcaaaggatgatgctaaaattaccgtgattctaagaatctcaaaaactcaattgtatgtgactgcccaagatgaagaccaaccagtgctgctgaaggagatgcctgagatacccaaaaccatcacaggtagtgagaccaacctcctcttcttctgggaaactcacggcactaagaactatttcacatcagttgcccatccaaacttgtttattgccacaaagcaagactactgggtgtgcttggcaggggggccaccctctatcactgactttcagatactggaaaaccaggcgtaggtctggagtctcacttgtctcacttgtgcagtgttgacagttcatatgtaccatgtacatgaagaagctaaatcctttactgttagtcatttgctgagcatgtactgagccttgtaattctaaatgaatgtttacactctttgtaagagtggaaccaacactaacatataatgttgttatttaaagaacaccctatattttgcatagtaccaatcattttaattattattcttcataacaattttaggaggaccagagctactgactatggctaccaaaaagactctacccatattacagatgggcaaattaaggcataagaaaactaagaaatatgcacaatagcagtcgaaacaagaagccacagacctaggatttcatgatttcatttcaactgtttgccttctgcttttaagttgctgatgaactcttaatcaaatagcataagtttctgggacctcagttttatcattttcaaaatggagggaataatacctaagccttcctgccgcaacagttttttatgctaatcagggaggtcattttggtaaaatacttctcgaagccgagcctcaagatgaaggcaaagcacgaaatgttattttttaattattatttatatatgtatttataaatatatttaagataattataatatactatatttatgggaaccccttcatcctctgagtgtgaccaggcatcctccacaatagcagacagtgttttctgggataagtaagtttgatttcattaatacagggcattttggtccaagttgtgcttatcccatagccaggaaactctgcattctagtacttgggagacctgtaatcatataataaatgtacattaattaccttgagccagtaattggtccgatctttgactcttttgccattaaacttacctgggcattcttgtttcattcaattccacctgcaatcaagtcctacaagctaaaattagatgaactcaactttgacaaccatgagaccactgttatcaaaactttcttttctggaatgtaatcaatgtttcttctaggttctaaaaattgtgatcagaccataatgttacattattatcaacaatagtgattgatagagtgttatcagtcataactaaataaagcttgcaacaaaattctctggctcagggcacatgcctcccctccccaggccgcggcccagctgaccctcggggctcccccggcagcggacagggaagggttaaaggcccccggctccctgccccctgccctggggaacccctggccctgtggggacatgaactgtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctgagggacaaattcccagctgacggggaccacaacctggattccctgcccaccctggccatgagtgcgggggcactgggagctctacagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctgatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctgggggacatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatcccagctgcggcatcctctgtctcagagtcttggtgtctctgttcctttcccctcggggtctccctgggtctccccaagtccctcctgctgtcttcctcccgctctctgatctctgactcccagaacctctccctctgtctccagggctgcccctctgatcctctttgcttctctggtgtgtctctctggctgcctccatctctgtggatctccgtctccctgtctctgtctcagtctgtccttcactctgtgtgtgtgtgtgtctctctctctctctctccttcccttccactccctcttcctcctgcctccacctctccaggcccctgtcttgtccctccgtccggcctttctctgcctttccgtcctcctgcctccccatctctctctgctagtcctgtccagccggacccccacccacagtcgggccccagcgcttgagcctgagtgtctgctccggcccgtggaggtggagggaggggacgccaatgacctcaccagcccctctccgaccacccccccctttcccttttcaacttttccaacttttccttccgtgccctcctccgagcgcggcggcgtgagccctgcaaggcagccgctccgtctgaatggaaaaggcaggcagggagggtgagtcaggatgtgtcaggccggccctcccctgccgcctgccccccgcccgcccgccccaggccccctatataaccccccaggcgtccacactccctcactgccgcgggccctgctgctcagggcacatgcctcccctccccagccgcgggcccagctgaccctcggggctcccccggcagcggacagggaagggttaaaggcccccggctccctgccccctgccctggggaacccctggccctgtggggacatgaactgtaagttggttcatggggagggtggaggggacagggaggcagggaggagagggacccacggcgggggtgggagcagaccccgctgagtcgcacagagagggacccggagacaggcagccggggaggagagcagcttcggagacaggaggcggcggaggagatgggcagagagagacacagacaggagcggatggaggcagccaatcagaggcgccgcaggagggacgggccagacagggcccgagaggagcgagacgcgagaccgagcaggggcagggacgcagggactggtgccgggagggaggtgacccccatcgacccaggccccagggagcccgcggggaccgggagactccctgggattccggcagagaggctccggagggaaactgaggcagggtccgcggagagcggagcaagccagggagtagcgaccccagccggggggaggagagagactgggcgccgggggaaagcggggagagccgggcagatgcggccgacggaggcgcggacagaccgacggctggcgggcccggggggcgggctgggggtgtgcgaggcgcgggcggccggggagcgctgattggctggcgggtggccgggtgggcggggcggccggggtgggctgcggggagcgagctccggacccccgcgcccccggcgccccccgcgccccccgccgccagctctcccgctcccggcgcccggccgggccatggctctgcccctctccgcccaggtgcgctgcggcccgggcttctgccgcccacccggcgggctcctgggagggcgtctaaggggtctcccgtgggagaggtccgtgtctcccggactccgtcctgggcttttggctccttcccctgctcccagccagctcgggctcccgcggcccggggagggggcaggttctggcctgtgcctcccccaccatccgcgccccggggcccagattccggcgtccgggggcggacgggagacgcccgggccgcgtctgctccgacgggcggggcagccagagccagggagggagagggaagcccgcctggccctgcgacctgcccgcgggcgttccaccctgggacttaagacctccagctccatcctccctaaggccgggagtccaggccccagaccctcctccccgagacccaggagtccagaccccaggccttcctccctcagacctaggagtccaggcccccagcctctcctccctcagacccaggaggagtccagaccccagttcctcctccctcagacccgggagtccagcccaggccctcctctctcagacccggagtccagcctgagctctctgccttatcctgcccccaggtgtttgccgcctggtcctggtcgtgctgagcctgtggccagatacagctgtcgcccctgggccaccacctggcccccctcgagtttccccagaccctcgggccgagctggacagcaccgtgctcctgacccgctctctcctggcggacacgcggcagctggctgcacagctggtaggagagactgggctggggccagcacaggagtgagaggcagagaggaacggagaggagtctgcgggcagccacttggaggggttctgggctctcaggtggcagagtgagggaggggaagagttgggggcctggcgtgggggatggagggagccccgaggctgggcaggggccacctcacagcttttttccctgccagagggacaaattcccagctgacggggaccacaacctggattccctgcccaccctggccatgagtgcaggggcactgggagctctacaggtaagggcaagggagtgggctggggacaaggtgggaggcaggcagtgaagggggcggggaggatgaggggcactggtcgggtgttctctgatgtcccggctctatccccagctcccaggtgtgctgacaaggctgcgagcggacctactgtcctacctgcggcacgtgcagtggctgcgccgggcaggtggctcttccctgaagaccctggagcccgagctgggcaccctgcaggcccgactggaccggctgctgcgccggctgcagctcctggtatgtcctggccccaagacctgacaccccagacccccacccctggccccaaaatcctgtggcctgagtccttgaagcctgagaccccagacccgagtgcaacagccccgctctgagaccctgacaccctaacagcccgctctgagaccctgacaccgtaacagccccgctctgagaccctgaccctaacagtcctgctctgagaccctgaccctgcagtcccaagatcctgtggccctgagaccctgaggccctagacccccaaatcctgcccagaaacttcaaattctcacccaagaccctgagactccatcatccatgacctcaaagtccccagatcccagcccctaagacccaagaccccatcctgaagcccaaagccttgagaattcaaatcctcacctcaagacttggagaccctggccccatgacattgaaaaccatggacctggccaggcgtggtggctcacgcctgtaatcccagcactttgggaggccgaggcaagtggatcacctgaggtcgggagttcaagaccagccagaccaacatggtgaaaccctgtctctactaaaaatacaaaattagccaggcgtggtggtgcatgcctgtaatcccagctacttgggaggctgaggcaggagaatcgcttgaacctgggaggcggaggttgcagtgagccgagatcgcaccattacactccagcctgggcaacaagagcaaaactccctctctctcaaaaaaaaaaaaaaaaaaaaaaaagaaggaaaagaaaaccatggacctccagaccctgagaccccaggccccagccctgagatcctgacatcttaaagatcccaggccctaagatacaagaccttgacccaaagccagccttgggaccctggctgtacaaacccaagacctccaggacctagaccccgagccctgaggccctatgtctcactcccaacatcgaaaaccctgacacctcagatcctgagcctgcgcctgtacgactccaagaccctcacttccaaagccaggcccaaagccctgagaccagaagacttcaaaccctggttcttgggcctaactccaaagaccctggatctcaaattccaacttctagctctgagactccagccctcacccatgagttcctgaacttgaacccagagaccccatctctaagacttcagccttgagatccagggcctgaccctagactcgagcccacagacctcagatactgtctgtaaaaccccagctctggtggggagcagtggctcactcctgtaatcccaaggcaggggaggccaaggcagaaggacctcttgaggccatgagtttgagacagcctgggcagcatagcaagactctgtttcttaattattattattattattattttttggagacagagtctcgcgctctgttgcccaggctagagtgcaatggtgccatttcggcttgctggaacctccgcctcctgggctcaagcgattctcctgcctcagcctcctgagtagctgggacttcaggtgcacactgccacacccggataatttttttgtattttagtagacacagggtttcaccgtgttgcccaggctggtcacaaactcctgagctcaggccatccgcccgcctcggcctcccaaagcgctgggataacaggcgtgacgccgcgcctggcttcttaattgttctaacagcagcgacaacaacaaaaacccagctctgagattccagccccggcgactctaacagtcccaggcccgatccctcacctagaaccgagatgccagccctgactccacagacttcacccccaacccccacactcagctctggaagcccgtcctgactccagcctccattttcggaaccccacagcctgaagagctcccggcctaaacacttcaccccacgcgccacagtccccctgtgaatatgcagccccgattcagctgcagctccacagcacccctgccctgcacccccgctgcaccccctacctgtgactcacctctctcctctccccacagatgtcccgcctggccctgccccagccacccccggacccgccggcgcccccgctggcgcccccctcctcagcctgggggggcatcagggccgcccacgccatcctgggggggctgcacctgacacttgactgggccgtgaggggactgctgctgctgaagactcggctgtgacccggggcccaaagccaccaccgtccttccaaagccagatcttatttatttatttatttcagtactgggggcgaaacagccaggtgatccccccgccattatctccccctagttagagacagtccttccgtgaggcctggggggcatctgtgccttatttatacttatttatttcaggagcaggggtgggaggcaggtggactcctgggtccccgaggaggaggggactggggtcccggattcttgggtctccaagaagtctgtccacagacttctgccctggctcttccccatctaggcctgggcaggaacatatattatttatttaagcaattacttttcatgttggggtggggacggaggggaaagggaagcctgggtttttgtacaaaaatgtgagaaacctttgtgagacagagaacagggaattaaatgtgtcatacatatccacttgagggcgatttgtctgagagctggggctggatgcttgggtaactggggcagggcaggtggaggggagacctccattcaggtggaggtcccgagtgggcggggcagcgactgggagatgggtcggtcacccagacagctctgtggaggcagggtctgagccttgcctggggccccgcactgcatagggccgtttgtttgttttttgagatggagtctcgctctgttgcctaggctggagtgcagtgaggcaatctaaggtcactgcaacctccacctcccgggttcaagcaattctcctgcctcagcctcccgattagctgggatcacaggtgtgcaccaccatgcccagctaattatttatttcttttgtatttttagtagagacagggtttcaccatgttggccaggctggtttcgaactcctgacctcaggtgatcctcctgcctcggcctcccaaagtgctgggattacaggtgtgagccaccacacctgacccataggtcttcaataaatatttaatggaaggttccacaagtcaccctgtgatcaacagtacccgtatgggacaaagctgcaaggtcaagatggttcattatggctgtgttcaccatagcaaactggaaacaatctagatatccaacagtgagggttaagcaacatggtgcatctgtggatagaacgccacccagccgcccggagcagggactgtcattcagggaggctaaggagagaggcttgcttgggatatagaaagatatcctgacattggccaggcatggtggctcacgcctgtaatcctggcactttgggaggacgaagcgagtggatcactgaagtccaagagtttgagaccggcctgcgagacatggcaaaaccctgtctcaaaaaagaaagaatgatgtcctgacatgaaacagcaggctacaaaaccactgcatgctgtgatcccaattttgtgtttttctttctatatatggattaaaacaaaaatcctaaagggaaatacgccaaaatgttgacaatgactgtctccaggtcaaaggagagaggtgggattgtgggtgacttttaatgtgtatgattgtctgtattttacagaatttctgccatgactgtgtattttgcatgacacattttaaaaataataaacactatttttagaataacagaatatcagcctcctcctctccaaaaataagccctcaggaggggacaaagttgaccgctgattgagcctgtcagggctgtgcac

SEQ ID NO: 3005 - DNA, 11786 bp; single-stranded, linear
atgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtctcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgcccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagatgagtgtcagaagtgtgaagggtgcctgttctgaatcccagagcctcctctccctctgtgaggctggcaggtgaggaagggtttaacctcactggaaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctacgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagcgcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatgatttgctggagtgctggctccacgccctggggagtgagcttggtgcggtaggtgctggcctcaaacagccacgaggtggtagctctgagccctccttcttgccctgagctttccggggaggagcctggagtgtaattacctgtcatctgggccaccagctccactggcccccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggaggagtacccccctgagagcatgtgggggaaggccttgctgtcatgtgaatccctcaatacccctagtatctggctgggttttcaggggctttggaagctctgttgcaggtgtccgggggtctaggactttagggatctgggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcggttgaccttctgaacatgagtgtcaactccaggacttgcttccaagcccttccctctgttggaaattgggtgtgccctggctcccaagggaggcccatgtgactaataaaaaactgtgaaccctcgcatttgtgttttaataaaagaatctggaagataaatagtcttgaagagagacaaaggaaggaaaatttaaatccttagattcaagcagaagaattccatgtggaaggtttgggttgttgttgttgttgtttggtgtgttttttgtttttttgtttttttgtttttttttgagatggagtctcgctgtgttaccgggagcgacagagccgcacggccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccgcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagagatggagggcggcatggcggggcgggtcgccggggcgggcbcbggcggcgggcbcgcggcctggggbgggcggcgbtggbgggggctgggcgcggcctggaaagctgagatggagggcggcatggcgggcacaggctgggcatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtctcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagatgagtgtcagaagtgtgaagggtgcctgttctgaatcccagagcctcctctccctctgtgaggctggcaggtgaggaagggtttaacctcactggaaggaatccctggagctagcggctgctgaaggcgtcgaggtgtgggggcacttggacagaacagtcaggcagccgggagctctgccagctttggtgaccttgggccgggctgggagcgctgcggcgggagccggaggactatgagctgccgcgcgttgtccagagcccagcccagccctacgcgcgcggcccggagctctgttccctggaactttgggcactgcctctgggacccctgccggccagcaggcaggatggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccagcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagcgcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccagaggcagctaaggggcaggaatcaaggagcctccgttcccacctctgaggactctggaccccaggccataccaggtgctagggtgcctgctctccttgccctgggccagcccaggattgtacgtgggagaggcagaaagggtaggttcagtaatcatttctgatgatttgctggagtgctggctccacgccctggggagtgagcttggtgcggtaggtgctggcctcaaacagccacgaggtggtagctctgagccctccttcttgccctgagctttccggggaggagcctggagtgtaattacctgtcatctgggccaccagctccactggcccccgttgccgggcctggactgtcctaggtgaccccatctctgctgcttctgggcctgatggagaggagaacactagacatgccaactcgggagcattctgcctgcctgggaacggggtggacgagggagtgtctgtaaggactcagtgttgactgtaggcgcccctggggtgggtttagcaggctgcagcaggcagaggaggagtacccccctgagagcatgtgggggaaggccttgctgtcatgtgaatccctcaatacccctagtatctggctgggttttcaggggctttggaagctctgttgcaggtgtccgggggtctaggactttagggatctgggatctggggaaggaccaacccatgccctgccaagcctggagcccctgtgttggggggcaaggtgggggagcctggagcccctgtgtgggagggcgaggcgggggagcctggagcccctgtgtgggagggcgaggcgggggatcctggagcccctgtgtcggggggcgagggaggggaggtggccgtcggttgaccttctgaacatgagtgtcaactccaggacttgcttccaagcccttccctctgttggaaattgggtgtgccctggctcccaagggaggcccatgtgactaataaaaaactgtgaaccctcgcatttgtgttttaataaaagaatctggaagataaatagtcttgaagagagacaaaggaaggaaaatttaaatccttagattcaagcagaagaattccatgtggaaggtttgggttgttgttgttgttgtttggtgtgttttttgtttttttgtttttttgtttttttttgagatggagtctcgctgtgttaccgggagcgacagagccgcacggccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtgcttgcctcgtgccccttggtgcccgtctgctgatgtgcccagcctgtgcccgccatgccgccctccatctcagctttccaggccgcctacatcggcatcgaggtgctcatcgccctggtctctgtgcccgggaacgtgctggtgatctgggcggtgaaggtgaaccaggcgctgcgggatgccaccttctgcttcatcgtgtcgctggcggtggctgatgtggccgtgggtgccctggtcatccccctcgccatcctcatcaacattgggccacagacctacttccacacctgcctcatggttgcctgtccggtcctcatcctcacccagagctccatcctggccctgctggcaattgctgtggaccgctacctccgggtcaagatccctctccggtacaagatggtggtgaccccccggagggcggcggtggccatagccggctgctggatcctctccttcgtggtgggactgacccctatgtttggctggaacaatctgagtgcggtggagcgggcctgggcagccaacggcagcatgggggagcccgtgatcaagtgcgagttcgagaaggtcatcagcatggagtacatggtctacttcaacttctttgtgtgggtgctgcccccgcttctcctcatggtcctcatctacctggaggtcttctacctaatccgcaagcagctcaacaagaaggtgtcggcctcctccggcgacccgcagaagtactatgggaaggagctgaagatcgccaagtcgctggccctcatcctcttcctctttgccctcagctggctgcctttgcacatcctcaactgcatcaccctcttctgcccgtcctgccacaagcccagcatccttacctacattgccatcttcctcacgcacggcaactcggccatgaaccccattgtctatgccttccgcatccagaagttccgcgtcaccttccttaagatttggaatgaccatttccgctgccagcctgcacctcccattgacgaggatctcccagaagagaggcctgatgactagaccccgccttccgctcccaccgcccacatccagtggggtctcagtccagtcctcacatgcccgctgtcccaggggtctccctgagcctgccccagctgggctgttggctgggggcatgggggaggctctgaagagatacccacagagtgtggtccctccactaggagttaactaccctacacctctgggccctgcaggaggcctgggagggcaagggtcctacggagggaccaggtgtctagaggcaacagtgttctgagcccccacctgcctgaccatcccatgagcagtccagagcttcagggctgggcaggtcctggggaggctgagactgcagaggagccacctgggctgggagaaggtgcttgggcttctgcggtgaggcaggggagtctgcttgtcttagatgttggtggtgcagccccaggaccaagcttaaggagaggagagcatctgctctgagacggatggaaggagagaggttgaggatgcactggcctgttctgtaggagagactggccaga

SEQ ID NO: 3006 - DNA, 7144 bp; single-stranded, linear
ggcgccgtgccgcgtcttggtggcggcgggttcgcgcccgcgcggggcccctccggtccgttcgcgcccgcgcggggcccctccggtcccgggtcggggccccccgcggccgcctcggggctggggcgctggtggccgggccgcgcctccgcctgccgcttctggctgggccccgggcgccccctcccctcttgctcgggtccccgtgacagcgcgtcctgtgtctccagcagcatggccgggccagctgggccccbcbgcgcgtcctgtgtctccbgcbgcbtggccgggccbgctgggcccccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtagcaccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatgtatacttgttgccaggaaggtgacctcaaaaattaaaagtataattattcggccgggcatggtggctcacacctgtaattccagcactttgggaggccaaggcaggcggatcacgaggtcaggagttcaaaaccagcctgtccaatatagtggggcaatttgttagttatccgccgccaccaagacgcggcacggcgcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatgcccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtagcaccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatgtatacttgttgccaggaaggtgacctcaaaaattaaaagtataattattcggccgggcatggtggctcacacctgtaattccagcactttgggaggccaaggcaggcggatcacgaggtcaggagttcaaaaccagcctgtccaatatagtggggcaatttgttagttatccgccgccaccaagacgcggcacggcgcctggaccggaggggccccgcgcgggcgcgaactttgggctcgggcgagtgggtggtgctccgcccagcccgagacgggcgggcgcgcgggccaatgggtgccgcctcttggccgcggggggccccgacccgtgggtcccggccaccagcgccccagccccgaggctcagaagcggcaggcggaggcgcggtccgggcgctatggccatgcccggcgggtctcacgcggctgcccctcgcccggcgcgccttcggtagggggcgcccggggcccagctggcccggccatgctgctggagacacaggacgcgctgtacgtggcgctggagctggtcatcgccgcgctttcggtggcgggcaacgtgctggtgtgcgccgcggtgggcacggcgaacactctgcagacgcccaccaactacttcctggtgtccctggctgcggccgacgtggccgtggggctcttcgccatcccctttgccatcaccatcagcctgggcttctgcactgacttctacggctgcctcttcctcgcctgcttcgtgctggtgctcacgcagagctccatcttcagccttctggccgtggcagtcgacagatacctggccatctgtgtcccgctcaggtataaaagtttggtcacggggacccgagcaagaggggtcattgctgtcctctgggtccttgcctttggcatcggattgactccattcctggggtggaacagtaaagacagtgccaccaacaactgcacagaaccctgggatggaaccacgaatgaaagctgctgccttgtgaagtgtctctttgagaatgtggtccccatgagctacatggtatatttcaatttctttgggtgtgttctgcccccactgcttataatgctggtgatctacattaagatcttcctggtggcctgcaggcagcttcagcgcactgagctgatggaccactcgaggaccaccctccagcgggagatccatgcagccaagtcactggccatgattgtggggatttttgccctgtgctggttacctgtgcatgctgttaactgtgtcactcttttccagccagctcagggtaaaaataagcccaagtgggcaatgaatatggccattcttctgtcacatgccaattcagttgtcaatcccattgtctatgcttaccggaaccgagacttccgctacacttttcacaaaattatctccaggtatcttctctgccaagcagatgtcaagagtgggaatggtcaggctggggtacagcctgctctcggtgtgggcctatgatctaggctctcgcctcttccaggagaagatacaaatccacaagaaacaaagaggacacggctggttttcattgtgaaagatagctacacctcacaaggaaatggactgcctctcttgagcacttccctggagctaccacgtatctagctaatatgtatgtgtcagtagtaggctccaaggattgacaaatatatttatgatctattcagctgcttttactgtgtggattatgccaacagcttgaatggattctaacagactcttttgtttttaaaagtctgccttgtttatggtggaaaattactgaaactattttactgtgaaacagtgtgaactattataatgcaaatactttttaacttagaggcaatggaaaaataaaagttgactgtactaaaaatg

SEQ ID NO: 3007 - DNA, 11395 bp; single-stranded, linear
acagagcagtgctgttgttgggcatcttgccttcccagggbcbgbgcbtgctgttgttgggcbtcttgccttcccbgggcccttttctggtggggtggtgctgttgttgggctttcttctgttcccbcbgbgcbgtgctgttgttgggcbtcttgccttcccbgggcccttttctggtggggtggtgctgttgttgggctttcttctgttcccgaattcccagatgggcagaggtggctgggctggtgaccctaagtgtgtctcctgcctttattctctctagtgggttattctttcatgtggtatcttgcctacagcatgctgtgtttggacacaaacccctttccttggtttctctgacccagctgagatggactgattccaaaagaactcacctatgtactggggtaggggagggagggttttttgcagtatttaactaaggttcaaagagtgctatatagtgagaaaggcttcttttttttttttttttttttttggcagagtgctgcctcctagaaatttctcttggtaacttccttctctgaagcacagataaagaaaacaattacagtagaaacatttatgagggacacattggaggccgatgaagcttttcaagttccagcagtgcagggatgtgggcagaactgacattggaaaatactagaatgatggaaattcagttggagaggactgccctttttaatgtctggggagtctgctcagggagaaatgacaagtctggcggggacaagtatgggatttggtaagacttggatcaacttgggatacagggtgggggtcgggagtggaatcaatgaatgatgccagagcagatcaactaacaagaggaccctgatgagccccaggcagaggcgtctcccttatgccccactctgaagtgtttgttagtaaacaccagaacgccattgttgttactgctgaattttattttgggctgtacatatttagatgcttaaggtaaaaatgataaagccctcaagccactgtgtgggtttgggtccaagtgttccttcttgctgcctctctaacacgcctggttaaaataatccctttggatggtgctgagaagcacctgaaccaagtgggtccccaaataacaatggcgtgcaagtgtctggttcccagaagttggtgactaggtaagcagcttcagggagagggggctgattcccagacagtcgcctgttcctgcggggatggggctgaggcttggggaatgtgggcaggaggatatgccatttgattctgttgcacacgttcttttcccttctttctgtatgtctggtcattctgctattctgtcgttcctcacataggttggacattggccggctgccagcataagtgccagtgtgattttgctaggtgtgagctgagaaagagaggtggaggctaagcaggtgtgatgcttctcagaggtgctgagtttttgcccttctgagcagggaatctttgcttatccctttgaccaaggatctttgctgcaaaggctgggtatcggctgtgctcagcaaagcgtcaactcgtgcaagaacttagcaggaatagttctggctaaggttaggaggctgccaccaaagtctcttttttgttcctctgcttctcccgtttgcctccttatcatgagatctttttgctaagctggcagaaagattgcatagtcagtgcttccagctctgctcccacctgatcctgcactgtcctctggtccctgaatgaatgaactctgatacccaatcttgtctcgagccttctctatgccactcatggctcctcttctgctctttccatctttttgctgagagttctgagctctgtacttcctcttggcccatctcacttcctgaaacacccctgaagagggttgcttatcttgatggaactcaaaaagccaaaaagctgcaggcagaggcgttgaggacatctgtttggggaactaagagcagcagcactttcagattcagtccatatagagctgtcctacagcattctggaaacttgaggatgtgcggtgcataaaggggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcaggtagcctgcggcgtggggtgggcagcaattgaggcagctgggaaatgaggctacaaagccagagcctgctgaattttattttggactgtacatatttagatgcttaaggtaaaaatgataaagccctcaagccactgtgtgggttgggtccaagtgttccttgctgctgcctctctaacacgcctggttaaaataatccctttggatggtgctgagaagcacctgaaccaagtgggtccccaaataactatggcgtgcaagtgtctggttcccagaagttggtgactaggtaagcgactcagggagaggggctgattcccagacagtcgcctgttcctgctgggatggggctgaggcttggggaatgtgggcaggaggatatgccatttgattctgttgcacacgttcttttcccttctttctgtatgtctggtcattctgctattctgtcgttcctcacataggttggacattggccggctgccagcataagtgccagtgtgattttgctagggtgtgagctgagaaagagaggtggaggctaagcaggtgtgatgcttctcagaggtgctgagtttttgcccttctgagcagggaatctttgcttatccctttgaccaaggatctttgctccaaaggctgggtatcggctgtgctcagcaaagcgtcaactcgtgcaagaacttagcaggaatagttctggctaaggttaggaggctgccaccaaagtctcttttttgttcctctgcttctcccgtttgcctccttatcatgagatctttttgctaagctggcagaaagattgcataatcagtgcttccagctccgctcccacctgatcctgcactgtcctctggtccctgaatgaatgaactctgatacccaatcttgtctcgagccttctctatgccactcatggctcctcttctgctctttccatctttttgctgagagttactgagctctgtacttcctcttggcccatctcacttcctgaaacacccctgaagagggttgcttatcttgatggaactcaaaaagccaaaaagctgcaggcagaggcgttgaggacatctgtttggggaactaagagcagcagcactttcagattcagtccatatagagctgtcctacagcattctggaaacttgaggatgtgcggtgcataaaggggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgcgaattcgggggacatctgtttggggaactaagagcagcagcactttcagattcagtccatatagagctgtcctacagcattctggaaacttgaggatgtgcggtgcataaacgggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcagatacaagagggtcaccactcacagaagaatatggctggccctgggcctttgctggctggtgtcattcctggtgggattgacccccatgtttggctggaacatgaaactgacctcagagtaccacagaaatgtcaccttcctttcatgccaatttgtttccgtcatgaggatggactacatggtatacttcagcttcctcacctggattttcatccccctggttgtcatgtgcgccatctatcttgacatcttttacatcattcggaacaaactcagtctgaacttatctaactccaaagagacaggtgcattttatggacgggagttcaagacggctaagtccttgtttctggttcttttcttgtttgctctgtcatggctgcctttatctctcatcaactgcatcatctactttaatggtgaggtaccacagcttgtgctgtacatgggcatcctgctgtcccatgccaactccatgatgaaccctatcgtctatgcctataaaataaagaagttcaaggaaacctaccttttgatcctcaaagcctgtgtggtctgccatccctctgattctttggacacaagcattgagaagaattctgagtagttatccatcagagatgactctgtctcattgaccttcagattccccatcaacaaacacttgagggcctgtatgcctgggccaagggatttttacatccttgattacttccactgaggtgggagcatctccagtgctccccaattatatctcccccactccactactctcttcctccacttcatttttcctttgtcctttctctctaattcagtgttttggaggcctgacttggggacaacgtattattgatattattgtctgttttccttcttcccaatagaagaataagtcatggagcctgaagggtgcctagttgacttactgacaaaaggctctagttgggctgaacatgtgtgtggtggtgactcatttccatgccattgtggaattgagcagagaacctgctctcggaggatgcctaggagatgttgggaacagaagaaataaactgagtttaagggggacttaaactgctgaattcgaattcccagatgggcagaggtggctgggctggtgaccctaagtgtgtctcctgcctttattctctctagtgggttattctttcatgtggtatcttgcctacagcatgctgtgtttggacacaaacccctttccttggtttctctgacccagctgagatggactgattccaaaagaactcacctatgtactggggtaggggagggagggttttttgcagtatttaactaaggttcaaagagtgctatatagtgagaaaggcttcttttttttttttttttttttttggcagagtgctgcctcctagaaatttctcttggtaacttccttctctgaagcacagataaagaaaacaattacagtagaaacatttatgagggacacattggaggccgatgaagcttttcaagttccagcagtgcagggatgtgggcagaactgacattggaaaatactagaatgatggaaattcagttggagaggactgccctttttaatgtctggggagtctgctcagggagaaatgacaagtctggcggggacaagtatgggatttggtaagacttggatcaacttgggatacagggtgggggtcgggagtggaatcaatgaatgatgccagagcagatcaactaacaagaggaccctgatgagccccaggcagaggcgtctcccttatgccccactctgaagtgtttgttagtaaacaccagaacgccattgttgttactgctgaattttattttgggctgtacatatttagatgcttaaggtaaaaatgataaagccctcaagccactgtgtgggtttgggtccaagtgttccttcttgctgcctctctaacacgcctggttaaaataatccctttggatggtgctgagaagcacctgaaccaagtgggtccccaaataacaatggcgtgcaagtgtctggttcccagaagttggtgactaggtaagcagcttcagggagagggggctgattcccagacagtcgcctgttcctgcggggatggggctgaggcttggggaatgtgggcaggaggatatgccatttgattctgttgcacacgttcttttcccttctttctgtatgtctggtcattctgctattctgtcgttcctcacataggttggacattggccggctgccagcataagtgccagtgtgattttgctaggtgtgagctgagaaagagaggtggaggctaagcaggtgtgatgcttctcagaggtgctgagtttttgcccttctgagcagggaatctttgcttatccctttgaccaaggatctttgctgcaaaggctgggtatcggctgtgctcagcaaagcgtcaactcgtgcaagaacttagcaggaatagttctggctaaggttaggaggctgccaccaaagtctcttttttgttcctctgcttctcccgtttgcctccttatcatgagatctttttgctaagctggcagaaagattgcatagtcagtgcttccagctctgctcccacctgatcctgcactgtcctctggtccctgaatgaatgaactctgatacccaatcttgtctcgagccttctctatgccactcatggctcctcttctgctctttccatctttttgctgagagttctgagctctgtacttcctcttggcccatctcacttcctgaaacacccctgaagagggttgcttatcttgatggaactcaaaaagccaaaaagctgcaggcagaggcgttgaggacatctgtttggggaactaagagcagcagcactttcagattcagtccatatagagctgtcctacagcattctggaaacttgaggatgtgcggtgcataaaggggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcaggtagcctgcggcgtggggtgggcagcaattgaggcagctgggaaatgaggctacaaagccagagcctgctgaattttattttggactgtacatatttagatgcttaaggtaaaaatgataaagccctcaagccactgtgtgggttgggtccaagtgttccttgctgctgcctctctaacacgcctggttaaaataatccctttggatggtgctgagaagcacctgaaccaagtgggtccccaaataactatggcgtgcaagtgtctggttcccagaagttggtgactaggtaagcgactcagggagaggggctgattcccagacagtcgcctgttcctgctgggatggggctgaggcttggggaatgtgggcaggaggatatgccatttgattctgttgcacacgttcttttcccttctttctgtatgtctggtcattctgctattctgtcgttcctcacataggttggacattggccggctgccagcataagtgccagtgtgattttgctagggtgtgagctgagaaagagaggtggaggctaagcaggtgtgatgcttctcagaggtgctgagtttttgcccttctgagcagggaatctttgcttatccctttgaccaaggatctttgctccaaaggctgggtatcggctgtgctcagcaaagcgtcaactcgtgcaagaacttagcaggaatagttctggctaaggttaggaggctgccaccaaagtctcttttttgttcctctgcttctcccgtttgcctccttatcatgagatctttttgctaagctggcagaaagattgcataatcagtgcttccagctccgctcccacctgatcctgcactgtcctctggtccctgaatgaatgaactctgatacccaatcttgtctcgagccttctctatgccactcatggctcctcttctgctctttccatctttttgctgagagttactgagctctgtacttcctcttggcccatctcacttcctgaaacacccctgaagagggttgcttatcttgatggaactcaaaaagccaaaaagctgcaggcagaggcgttgaggacatctgtttggggaactaagagcagcagcactttcagattcagtccatatagagctgtcctacagcattctggaaacttgaggatgtgcggtgcataaaggggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgcgaattcgggggacatctgtttggggaactaagagcagcagcactttcagattcagtccatatagagctgtcctacagcattctggaaacttgaggatgtgcggtgcataaacgggctggaagtgacccacctgtgatgagccctttctaaggagaagggtttccaagagatcaccccaccagaaaagggtaggaatgagcaagttgggaattttagactgtcactgcacatggacctctgggaagacgtctggcgagagctaggcccactggccctacagacggatcttgctggctcacctgtccctgtggaggttcccctgggaaggcaagatgcccaacaacagcactgctctgtcattggccaatgttacctacatcaccatggaaattttcattggactctgcgccatagtgggcaacgtgctggtcatctgcgtggtcaagctgaaccccagcctgcagaccaccaccttctatttcattgtctctctagccctggctgacattgctgttggggtgctggtcatgcctttggccattgttgtcagcctgggcatcacaatccacttctacagctgcctttttatgacttgcctactgcttatctttacccacgcctccatcatgtccttgctggccatcgctgtggaccgatacttgcgggtcaagcttaccgtcagatacaagagggtcaccactcacagaagaatatggctggccctgggcctttgctggctggtgtcattcctggtgggattgacccccatgtttggctggaacatgaaactgacctcagagtaccacagaaatgtcaccttcctttcatgccaatttgtttccgtcatgaggatggactacatggtatacttcagcttcctcacctggattttcatccccctggttgtcatgtgcgccatctatcttgacatcttttacatcattcggaacaaactcagtctgaacttatctaactccaaagagacaggtgcattttatggacgggagttcaagacggctaagtccttgtttctggttcttttcttgtttgctctgtcatggctgcctttatctctcatcaactgcatcatctactttaatggtgaggtaccacagcttgtgctgtacatgggcatcctgctgtcccatgccaactccatgatgaaccctatcgtctatgcctataaaataaagaagttcaaggaaacctaccttttgatcctcaaagcctgtgtggtctgccatccctctgattctttggacacaagcattgagaagaattctgagtagttatccatcagagatgactctgtctcattgaccttcagattccccatcaacaaacacttgagggcctgtatgcctgggccaagggatttttacatccttgattacttccactgaggtgggagcatctccagtgctccccaattatatctcccccactccactactctcttcctccacttcatttttcctttgtcctttctctctaattcagtgttttggaggcctgacttggggacaacgtattattgatattattgtctgttttccttcttcccaatagaagaataagtcatggagcctgaagggtgcctagttgacttactgacaaaaggctctagttgggctgaacatgtgtgtggtggtgactcatttccatgccattgtggaattgagcagagaacctgctctcggaggatgcctaggagatgttgggaacagaagaaataaactgagtttaagggggacttaaactgctgaattc

SEQ ID NO: 3008 - DNA, 6103 bp; single-stranded, linear
gcgctcggcctggtcccgggggtctcctcttgttgttgcttgcgcctcctgctgggggtccctctgttcttgttttgggggcgggcccggccgttgtcttggtttgggggtttccgttggggttctcctggcccgggccttgcccggccgtggtcccggcttcgttcctgtctccgtctcggctcttctggggccttgcgctgtctttggtggcbccgtccbgtgbtggtgcggtbcttgtcgctgcbgcgctcggcctggtcccggbgbgccaccgctcctgtcagccaacaaatatccattgagcgacacctgtgtcccaggtgctgctctgggccctgggagaagtgcatcagtgggcttggtagtagagggtagggatggagtgaagggtaggcaggaagaatgtccccaggctggtaggaggtggggtggggggtttcagtctcaaaactcccatgaaaaccagagagaagtttcagaactccacccaagaggctgggtttctagggcccagagctgccctcccccaccctagaatgggctataaaagtcccttcccagctacgtccagagaagagctggaggaagtgagaggtcggctgggggtcctcaaagtgagaggggagcagaggatcctcccgtgcaggctgtggatgtcactcacttcccagctggtgaagcctcgctgcagagatgcatctgctcccagccctggcaggggtcctggccacactcgtcctcgcccagccctgtgagggcactgacccaggtaatagtcccctagacaggcaaggaggagggaggggaaatggaaggggaagcacttgggtcttggagggggtcttgtggcttgctgaaccctgagtccccatctctttgaacagcctcccctggggcagtggagacctcggtcctgcgagactgcatagcagaggccaagttgctggtggatgctgcctacaattggacccagaagaggtggacttgggtctgggggctgcatgggcctgggaggatcagttaataccttgtggggtcagggagcccatgtcccgtgctgatgttatttccccaccaggtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaaggtacctaccctcagccaatctcccatgcccttgtgtggcctcccccaaaggcaaggtgctgggggtggggatctggaagactggagcaccatccttaaggagctgcctgtggagctagggtatgagacagagacacaagcactgtctcctcttccatctcagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtcagacagggaggaaggtggtgtcttcccaggaaacagccatccctggggtcccaactgggaagcaatggtgggatgtggtgaaggtacatggtttgggacctcagtattaggcacaccataagcatggatctgtgcactgaagagatggaggtccagtgagggccaggagtttggcccaccccgtctctcccatccccagccctgggtctaccctggtagaaagacatttctctgggaaaggctgcagtaaatctgagcttggggttttcaaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccaggtaaggagctctgcatcccagcatcccccctttgtatctccacccaccaatagtaaattaatgttgtcacatttgacgtgatgacaataaagaatatgtctgagccaccctttgaaaaggcaagggtatgggtgagtagcctctggggaatgttcctcctgtcttcccttccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaaggtgaccaggttttccagggggcaaatgggggtgagggtggggagcatgccctcccctaggtggtccagctgcttcatgtctctccagaactctgtttcctgacaaacgttactaacatacccgactggcttgtccagctctgggctagcttggcatcatgtgataacccaagtagcttcccagaggctggtccaatctgtgctgctcacattccctgccaccagggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccaggtgagggggctgtccacctcttctcccagctttgctcgggccaggctgctcaaggggttctgggaagaccctggtacccgactgcctggtaggttctggtggcagaaacgaggtgttttcaccaaaagacagcgcaaggccctgagcagaatttccttgtctcgaattatatgtgacaataccggtatcaccacggtttcaagggacatcttcagagccaacatctaccctcggggctttgtgaactgcagccgtatccccaggttgaacctatcagcctggcgagggacatgaggcttctgcaggtaaggggaggccacctccagcaccctgggctggttaagcctcacatccttccctggatggatggctgagtcctcttaggtctctaagcagagaaaacagaacttgtcactaggtactctttccaagtggcttcccaatgtgctagtttctgggctgacagtcaattccaggccctaggactttggggggaaattaggagcatccaactagaattccgtggccaggacccctgccagggcactgacccagcctcccctggggcagtggagacctcggtcctgcgagactgcatagcagaggccaagttgctggtggatgctgcctacaattggacccagaagagcatcaagcagcggcttcgcagcggttcagccagccccatggacctcctgtcctacttcaaacaaccggtagcagccaccaggacagttgttcgggccgcagattatatgcatgtggctttggggctgcttgaagagaagttacaaccccagcggtccggacccttcattgtcactgatgtgctaacagaaccacagctgcggctgctgtcccaggccagtggctgtgctctccgggaccaggccgagcgctgcagcgacaagtaccgcaccatcactggacggtgcaacaacaagaggagacccttgctaggggcctccaaccaggctctggctcgctggctgcccgccgagtatgaggatgggctgtcgctccccttcggctggacccccagcaggaggcgcaatggcttccttctccctcttgtccgggctgtctccaaccagattgtgcgcttccccaatgagagactgacctccgaccgtggccgagccctcatgttcatgcagtggggccagttcattgaccatgacctggacttctccccggagtccccggccagagtggccttcactgcaggcgttgactgtgagaggacctgcgcccagctgcccccctgctttcccatcaagatcccacccaatgacccccgcatcaagaaccagcgtgactgcatccctttcttccgctcggcaccctcatgcccccaaaacaagaacagagtccgcaaccagatcaacgcgctcacctcctttgtggacgccagcatggtgtatggcagtgaggtctccctctcgctgcggctccgcaaccggaccaactacctggggctgctggccatcaaccagcgctttcaagacaacggccgggccctgctgcccttcgacaacctgcacgatgacccctgtctcctcaccaaccgctcggcgcgcatcccctgcttcctggcaggtgacacccgatcaacggaaacccccaaactggcagccatgcacaccctctttatgcgagagcacaaccggctggccaccgagctgagacgcctgaatccccggtggaatggagacaaactgtacaatgaggctcggaagatcatgggggccatggtccagatcatcacctaccgagactttctgcccctggttctgggcaaggcccgggccaggagaaccctggggcactacagggggtactgctccaatgtggacccacgggtggccaatgtcttcaccctggccttccgctttggccacacaatgctccagcccttcatgttccgcttggacagtcagtaccgggcctccgcacccaactcgcatgtcccacttagctctgccttctttgccagctggcggatcgtgtatgaagggggcatcgaccccatcctccggggcctcatggccacccctgccaagctgaaccgtcaggatgccatgttagtggatgagctccgggaccggctgtttcggcaagtgaggaggattgggctggacctggcagctctcaacatgcaacgaagccgggaccacggccttccagggtacaatgcttggaggcgcttctgtgggctctcccagccccggaatttggcacagcttagccgggtgctgaaaaaccaggacttggcaaggaagttcctgaatttgtatggaacacctgacaacattgacatctggattggggccatcgctgagcctcttttgccgggggctcgagtggggcctcttctggcttgtctgttcgagaaccagttcagaagagccgagacggagacaggttctggtggcagaacgaggtgttttcaccaaagacagcgcaaggccctgagcagaatttccttgtctcgaattatatgtgacaataccggtatcaccacggtttcaagggacatcttcagagccaacatctaccctcggggctttgtgaactgcagccgtatccccaggttgaacctatcagcctggcgagggacatgaggcttctgcaggagtctatcccaagtctccaacttttggagacaaggggaaggggaggaccatgaggctgccttgtctccctggagcaagtgcaggctcgtgacgcttctgctggctacagctcagagctgggttccccagccaggagtgaaggctgggggctcctatcagcaatggaccttccgccttgggagcctcttaggtattaggctatgaatcagcgccacgtgcaaaggcttgggagccaagccatgtggtcttgcaccccaggcaagaaaagtcagctggagggtttacagcactttctactgtttcccagccctccctcccctccctcaccatgactaagagaccactcggtcctagcctccagacaccccacaatactcctctgagcctgaggccaggcagcatgctctgcttctaccaataaagcactgccggaattc

SEQ ID NO: 3009 - DNA, 146982 bp; single-stranded, linear
bbgtgbgbgctgbgbgbbbctgtgbbgcbbtcbtgbcttcbbgbgttcttttcbcccgttcttggcttcttctgtccgttggcttctcgttgtccctgtgggcttctcgttgtccccccttcgggggctggtggggccgtccttgcctgctgggttcttggcttcttctgtccgttggcttctcgttgtccctgtgggcttctcgttgtccccccttcgggggctggtggggccgtccttgcctgctggcctgagacagaggcagcagtgatacccacctgagagatcctgtgtttgaacaactgcttcccaaaacggaaagtatttcaagcctaaacctttgggtgaaaagaactcttgaagtcatgattgcttcacagtttctctcagctctcactttggtgcttctcattaaagagagtggagcctggtcttacaacacctccacggaagctatgacttatgatgaggccagtgcttattgtcagcaaaggtacacacacctggttgcaattcaaaacaaagaagagattgagtacctaaactccatattgagctattcaccaagttattactggattggaatcagaaaagtcaacaatgtgtgggtctgggtaggaacccagaaacctctgacagaagaagccaagaactgggctccaggtgaacccaacaataggcaaaaagatgaggactgcgtggagatctacatcaagagagaaaaagatgtgggcatgtggaatgatgagaggtgcagcaagaagaagcttgccctatgctacacagctgcctgtaccaatacatcctgcagtggccacggtgaatgtgtagagaccatcaataattacacttgcaagtgtgaccctggcttcagtggactcaagtgtgagcaaattgtgaactgtacagccctggaatcccctgagcatggaagcctggtttgcagtcacccactgggaaacttcagctacaattcttcctgctctatcagctgtgataggggttacctgccaagcagcatggagaccatgcagtgtatgtcctctggagaatggagtgctcctattccagcctgcaatgtggttgagtgtgatgctgtgacaaatccagccaatgggttcgtggaatgtttccaaaaccctggaagcttcccatggaacacaacctgtacatttgactgtgaagaaggatttgaactaatgggagcccagagccttcagtgtacctcatctgggaattgggacaacgagaagccaacgtgtaaagctgtgacatgcagggccgtccgccagcctcagaatggctctgtgaggtgcagccattcccctgctggagagttcaccttcaaatcatcctgcaacttcacctgtgaggaaggcttcatgttgcagggaccagcccaggttgaatgcaccactcaagggcagtggacacagcaaatcccagtttgtgaagctttccagtgcacagccttgtccaaccccgagcgaggctacatgaattgtcttcctagtgcttctggcagtttccgttatgggtccagctgtgagttctcctgtgagcagggttttgtgttgaagggatccaaaaggctccaatgtggccccacaggggagtgggacaacgagaagcccacatgtgaagctgtgagatgcgatgctgtccaccagcccccgaagggtttggtgaggtgtgctcattcccctattggagaattcacctacaagtcctcttgtgccttcagctgtgaggagggatttgaattatatggatcaactcaacttgagtgcacatctcagggacaatggacagaagaggttccttcctgccaagtggtaaaatgttcaagcctggcagttccgggaaagatcaacatgagctgcagtggggagcccgtgtttggcactgtgtgcaagttcgcctgtcctgaaggatggacgctcaatggctctgcagctcggacatgtggagccacaggacactggtctggcctgctacctacctgtgaagctcccactgagtccaacattcccttggtagctggactttctgctgctggactctccctcctgacattagcaccatttctcctctggcttcggaaatgcttacggaaagcaaagaaatttgttcctgccagcagctgccaaagccttgaatcagacggaagctaccaaaagccttcttacatcctttaagttcaaaagaatcagaaacaggtgcatctggggaactagagggatacactgaagttaacagagacagataactctcctcgggtctctggcccttcttgcctactatgccagatgcctttatggctgaaaccgcaacacccatcaccacttcaatagatcaaagtccagcaggcaaggacggccttcaactgaaaagactcagtgttccctttcctactctcaggatcaagaaagtgttggctaatgaagggaaaggatattttcttccaagcaaaggtgaagagaccaagactctgaaatctcagaattccttttctaactctcccttgctcgctgtaaaatcttggcacagaaacacaatattttgtggctttctttcttttgcccttcacagtgtttcgacagctgattacacagttgctgtcataagaatgaataataattatccagagtttagaggaaaaaaatgactaaaaatattataacttaaaaaaatgacagatgttgaatgcccacaggcaaatgcatggagggttgttaatggtgcaaatcctactgaatgctctgtgcgagggttactatgcacaatttaatcactttcatccctatgggattcagtgcttcttaaagagttcttaaggattgtgatatttttacttgcattgaatatattataatcttccatacttcttcattcaatacaagtgtggtagggacttaaaaaacttgtaaatgctgtcaactatgatatggtaaaagttacttattctagattaccccctcattgtttattaacaaattatgttacatctgttttaaatttatttcaaaaagggaaactattgtcccctagcaaggcatgatgttaaccagaataaagttctgagtgtttttactacagttgttttttgaaaacatggtagaattggagagtaaaaactgaatggaaggtttgtatattgtcagatattttttcagaaatatgtggtttccacgatgaaaaacttccatgaggccaaacgttttgaactaataaaagcataaatgcaaacacacaaaggtataattttatgaatgtctttgttggaaaagaatacagaaagatggatgtgctttgcattcctacaaagatgtttgtcagatgtgatatgtaaacataattcttgtatattatggaagattttaaattcacaatagaaactcaccatgtaaaagagtcatctggtagatttttaacgaatgaagatgtctaatagttattccctatttgttttcttctgtatgttagggtgctctggaagagaggaatgcctgtgtgagcaagcatttatgtttatttataagcagatttaacaattccaaaggaatctccagttttcagttgatcactggcaatgaaaaattctcagtcagtaattgccaaagctgctctagccttgaggagtgtgagaatcaaaactctcctacacttccattaacttagcatgtgttgaaaaaaaaagtttcagagaagttctggctgaacactggcaacgacaaagccaacagtcaaaacagagatgtgataaggatcagaacagcagaggttcttttaaaggggcagaaaaactctgggaaataagagagaacaactactgtgatcaggctatgtatggaatacagtgttattttctttgaaattgtttaagtgttgtaaatatttatgtaaactgcattagaaattagctgtgtgaaataccagtgtggtttgtgtttgagttttattgagaattttaaattataacttaaaatattttataatttttaaagtatatatttatttaagcttatgtcagacctatttgacataacactataaaggttgacaataaatgtgcttatgtttgatcaaaatttttacctattatgcatttgatatataaataagtatataaatgcacacacagacacagcaatgatggtgaacagtcttcatacaattatatggatgaatctcataaaatgctgagttaaagaaatcagaccaaagaacatatactgaaagattctctctatatacaaagttcaaaaataggtggaccaattcatggtggtgttagaaatcagaagagaggctacctttgtggggaggggacagtttaatgcccagaagcggtaaataaggaatcctctggggagtggtaatgatctggatgctggctacaggatgtgttggttgtaaaaatgcatttttttatatctagctttttccatgtgtatattatacttcaaagaagttcagttaataatttctcatgtcactgtagagtagctcagttagccccagcaagcctctggcttaatcttgttttaccttaagccatcagtcatttacaagtaggaaaattcacagggaaagttagagtataaaatccagaatgaaggtttactgggtaagagtctctccattttccaaagcccgtttatttcttgattccagttcttaagaagtctcagcattgtgtctttttcatgtatcttacaagaagacagcatgtgcttctaacacctgatacattgtatctaccagcacttggtaaacagaaaagaaccacatttttcttgtaggagaaatttggtgcctatttcctaccaggcaccaataagtgggaccaataggtgggattaaagatacagtagaaagtatttaaaacttgccagggggcaatagtctgaaaataagtaaattggtgctatagaatggaagttacaggcttctttcttttttcccacaagatctgctccttgagcccctagagacttttctgtctgttactgtttcttcattcctcatctgcagagccagccctgagaagtgcagaccaaagccagggaaggctctgcaaagatgtacaaatggaagtcaccttaataacctctgactgctgcgcataatacatttcactcaaaagaggggttaaacaatggaacagaatacagaggccagaaataatgctgaacactgacaaccatctgatctttgacaaaatccacaaaaacaagcaatggagaaaggactccctattccataatggtgctgggataactgtctagctatatacagaagattgaacctgggccccttccttacatcatatacaaaaaataactcaagatggagtaaagacttaaatctaaaaccaaacactataaaaaccctggaagatagcctgggaaataccattctggacataggacctggcaaagacttcatgacaagacaccaaaagcaatagcaacaaaaaccaaattgactaatgaaactaatgaaactctttagttgtacaacagatagtttatctgtacaacaaaataaactatcaacagagtaaacaacctacagaatggaaaaattttttgcaaactatgcatctgacaaaggtctaatatccagaatctataaggaatttaaacaaatttacaagcaaaaaaatgacctcattaaaaagtgggcaaaggacatgaacagatgcttttcaaaataagacattcacacatccaacaaccatatgaaaagatgtttaacatcactaatcattagaggaatacaaatcaaaagcataataagataccatctaataccagtaggaatgactactattaaaaagtcagacaataacagatgctggtgaaggttgtggagaaaagggaatgtttatgcactgctagtgggaatgtaaactagttcagccattgtggaagagagtgtggtgattcctcaaagaatgtaaaaccgaactgcctttcaatccagcaatcccattattggatatacaccaaaaggaatagaaattgttttaccgtaaaggcgcatgcatgcatatgttcattacagcactatttacgatagcaaagacatggaatcgtctaaatgcccatcagtggtagactagctaaaaaaaaaaaaatgtggtacatatacatcacagaatagtatgcagccataaaaatgaacaagatcatcatgtcctttgcagcaacatggatgtagttggaggccattatcctaagcaaattaatgcaggaacagaaagccaaataccacatgttctcatttataagtgacagctaaatattgagtacacatggacacaaagaagggaacaatagacatgggacctacttgagaatagagggtgggaggagggtgaggatcaaaaagtacccataggacactgtgcttattacctgggtgatgaaataatttgcacaccaaacccctgtgacacacaatttacctatatagaaaacctgtgcatgtacccctgaacctaaaagttaatggtgggggggtggggttaagctactttgtggtataaatctgagcattcatattaaaataaaatatttacctcattagagtaattaacatttattaagcaaagagccaagtaccttacacacatgatgtttaatctcacaatgatctttaatctcataacaaccgtccattgtatgtacatatgtggaaattgagccttggagagattaaatgcatggggcatgccatttgactagaaactggaagcatcaggatttaaactcagttctgaatggttttgtaggctttgttttttccacattatagcatggcctgccatgaagaacaggtcctttctggtgtttgtcttgtttggtttaagtgaagcaaatatttatttaaatattcaagatatgctgttaaatttttactcaaaaatttgagtacagtatggatcttctgaagccaaataactcttattcaatgcttagttgagaaattttatggagtagttctcaatttttatgtagttccactgcaaaggtaagtcttatggaaagattcactgtaattttttttcctcatttggacatcagctttttcttttcctcagacccgctgaaagataatttttaaaataaaaaccttgtttttatatcaagtggggacattttttccaaatgaaaaccgtgtattcattttatatgataaaatcaatgttattatttttaaaattttgatttaaaaatcattaaaaataaattttcagatattacctgaaattctaccatccagagataatagtgcttaaagatttgatatatagacacacacacatatatacatatatatcatcctaaacttctttgtataaatgtatataaagtttttaataaaaactaggagattaatgccctttgaatgaaaataaatacaatgtgtatgctttaacatcttgcctttactttataacatttatcacagcagtcatgagataatgatttacatggtcattgttagtaagctaatagctaagtgcatgaactctggagctagcctccctggattttaatcccagatctgtcactgaccagctgagcaatactaggtaaattgctcttgttccttagtttcttcatctgtaaaatagagataaaaataatatccacctcataggattggtgtgagcattaaatgagcatacgtatgtaggccacttaacaacaatgccttcacatactgaacacaaatatacgagctgttgtcttattgggctcatgtttttcctaccactaagccgcatgcatgcaaggaccatgttggttttgttccacattgcatccccaacctggtatacagtgtgcattcaatagttgttgactattattactagtggcatttaacaaatatctgttaaatgagtgaagaaatacccatttactgcaagtgtgtctaatattgatggcataatgggggaaactcaaactctggagtcaaacaggttttaaaaccttattccctcatcctcagttattgacgttttttttttggcaggtgtgtgtgtgggacaacttattgaacttttctgaatttccagcttcgcatatataaaatagagatagtgattcattcttgcaatgtatggatttgagacaattgtgtaagtttatcaataaatagtagctatttttgtataagtattacatataatatccaggccactgctttgcataacccaaaaggggcaccattcatgcagaatacaacataaatggtgtccctggagcagtgcagtataggaaccctgaggggacctacagtatactttatagttcatagattacaaattatccctttatcagagtctctcaaggttggatgtatttgaggtccataagagcaatttaggattaacagtagctgcagaaaccatctgcagtgatattctcattttaaatccgcgggaaagaagacagctataaacttgggacctgggtttaagcattttaaatgccaagttcaccattttctaaaacacaacaaatacccagtgagagagggagaagggaagtaaatgcctctgaataagcaagttaatgtcagtagttgtactgtatgcatattgatgaacaatagaggaaccaatgtccaatcagatgagcaggatatttggcaataacaagttgcctttgaggaaaaatgattttcttggcaagttctttatcagcattacaaagctaaaagctacgcttatcatcacttatactagcataccctgttgtgcaaatgctgtctgtgtttgcatctgctattgttgatgcctggtgcatgaatcaggactccagcccacaagttttcccagaactttcttatggccatcatctttaagtgtctggtgaacagtcatagtttggtacacaaaagggtcaacctgggggatggctagggtttgactcagtcgttacatttcaatagagcaggaaggggaaatggtggcctgtaacctcagggaattttgccagttggtccaccccactctctctctcctgctctgaggaagtggcacagcctagaacagcaccacaggtgagagaaatgcaaaccctaaccagagaagcagactctttgccagtagtaatagttcaggaccaccaccagcttttattaaaatttttaataacactcaagtattggcagaaagaaataatcttgggttaactataactagaatattgactcttcctctgtggaagaatcagccaatcacatttgtttacatcagttcccctgaagaagaaaaatacactgatgttgcagcaagacaaatttaagctagatgtaaataacttcctttagcctgtaatgctaggctaattacatattggaactattttttcagggaagaattgtgtagggtttcagggaagaattctgaagaaaatatagagctgaaatgatcttgcagctcactgaaactgcagggtttagatccacactgatactcgttctattatcactgtaatgaaggctgatggaataagtaaaaatgttttgtattagtatgtttttacacttatttgcaaggcataaataggttaggttttgatcttaatttaattctaacatgtattgtgcacaagctgtgagcagttttcaggagttaggtatctggccatgactgatttttcaggagttaatcatctggtagaagggtcatacacaataggaagatgtgtgtgacaggttgtgatcattactataatcacacagagagctgtagaattttaggctggcagggtggctcacgcctgtaatcccagcactttgggaggccaaggcaggcggatcaagaggtcaggagatggagaccatcctggctaacacggtgaaaccccgtctgtactaaaaatacaaaaaaaaaaaaaagccaggcgtggtggtgggcgcctgtagtcccagctacttgggaggctgaggcaggagaatggcgtgaacccgggaggtggagcttgcagtgagccgagatcgcatcactgcaatccaacctgggcgacagagggagactcagtctcaaaaaaaaaaaaaaaaaaaagtcatgttagatccagaggggtagcaactggggctgggctgtcagtcaactcagtcaactcagtcaactctgctcccccacaggagatgccagtgatgcattttcatggccaacattgtcagtcagcatcattgaattactcctgattatagagacacagctgcaaacgattccccattaaatatgatgtttcttgcaatgtttggaaggtactcctttttagtaagggaaatcccctcttctggcttgctgaaagttttttctttccattttaaaaatcgtgaattcctttttgcaatattgaggtggttatatggtttctcttctctaatctgttaatatggtgatttaatggttagaaattttctaatgtaaattccactcatattgcagaaataaacctaaactgagcatgaggctatattttttatttgcttctatatttggttgctatacagtattatgtttaagatttgttcacatatatttgtgaatgggattggactatttttccttcttgccgatttttatctggtttttaaattaaggatattttagacttatgaaatatttggcaaacaatccttggcaagtaattttttggggaatttgttttggctattttgagtattacccaatatattttaattaagttattcttaatgttttcttaattaaaaaaattacctactctagagatattctttatgtactccagattttgtctatttataccacttttcttttttcctcgatgagtgtcatagatgttcatctatttttttatcttctttgatcttctcttattccttgtttctattaacttctgaagtttattattttcttttttccacttccttatggtttattctttcaatttttctctaacttcttaagttgggtgtttaatttttagcttgctttgcttttttaggataagcattaaaactacaaattttccttgttattcttttgctgcaccccaaattgttgatatttctattgtctaatttctattcaattagaatactttaaagtttctttttggtttttaaaaactaactttttaaattgacaaataaaaattgtgtatatttattgtgcacagcatatggctttgaaatatatgtacattgtggaatggctaaatttagcttattaatgtatgcattatctcacatacttatcattttttgtggtgagagctatgtgacttttgaacttatgagttatttaaatatttttaaattattaagcatattgggattttaagtaatttacctttttattattaacttataacaagtagaacagttaacctgtatgattctacatcattgaaatttattgacatttgcttcatagtctattatatggtctacttttgttcatgttacatctgtagtagaattggctaatagttgagtaaagtacacatatgtctatgaaatcaagtgtaatccagagaaaaagagaaatttactgaatatattgttctaggtgctattatatgttgtcatgtttaatcctcaccacaattgtatgaggcagccataattaattccactttacacatgaggagcctgagggttaaaaaaaaagctagctctactatttgtaaagaatgaagcaaagatacaaatgaaggcccacatatcctataactagatatttaagcattttaattcaagctttaaaactgctaaataaaatgtgctccaatttctatattgacagacataccttcctaatgagctggggttcgaatttagaaatctttgatgcttcagagtccacactgaaatgtggaggcacatagtgagttggtccccagccttcagtccacccaccttctctttactaaatcacctttcacatacatgtatgaacaccccagcctccaagtccaaaccctaaacaaaatgggacacccttgtgcatacacagagacacagcccatcctcaggaaaacctggaaaagtccatacaagttctggaagcaagcttgggacggtttcagtagtgtggtctataagggaggcctcagaagacaggttttcttaattctgtgaacttctcccacagtagaaagggtgctggaggagggtcagagtgaggacttctaaagcatgggtcctgagtaggggccactcttgcccaagtctaagaagggtactagaatagcacactactactagatactagaacccagatacaagcacaggtcttctgaaattaataataataataactattaccattattataccagtagctgtcatttatttagtgcttattatttgccagtcactgttctaaattctttacatgtattatacaactgccatataactgccatatgagggatgtaccctcattgtcaccattttaccgatgagaaaactggcataaaacgtttaagtaacttgtccaagttacagagcttagtgaagccacaatgttgctcaatttgctctcaaacttcaaagggatgggaaggacacctaagtcatagagtctttaagaatcagagctagaaggaatcttagatgttatctagtcagcctcctcccattacagtccaagagaagatggccctgagttacttgtagctatttttgcatgtgaattgcaagtgaatatacattctactgaagataaaagatatttaaagatatcgctggatataggaacagtggttttaaatctctaggctttaacttttctcagaacaagaaatcctttttggttttaatctatatgcacatctgtatttttctcaattatcgggtagtaaaatataacttttcttctgtaatattttttaactttaatgagtgttcctcataatagaaaagtttggaaaccattgctatgggtatatactttctaaagggatagtaatttctctagaatattcatttaatgctccagaagtaattagcacaattgtgcaagtctgtgcatcatcaactatacattctgcctgtttactccaaatccacatgaaactgattatacagtcaaaggcgagcccagtggagaggcatttttggagacttcctggtacattgagacagggtcggccagtctgcgttagggtcttggtcaaaactgcatttctgaaactaaactcagattgctttcttttaaggggtcagaactgattcaaatctacatttttaaaagccttagatgtggggcttttcctattcccagtctccgctattggtctttgtgaatccacaggcaatttggccacatccttgactctctcttatattaagaattaaacagctaagttcatgcagaggaaatataacaaaggagggactttcctacaagatctttgaaaaatggaacatttgcataagtcatatttagccagaactgttgttttatattttcctttctgaatactttgttacacctcctcccagccaaccccccccctccctgaccccaactagtcagagaccaaagccttcacaatggtttacacttgaaccttcctggccccaccctcatcatcacgcctgaataattacattcactgactggtctcccctgcttccgtttatctccactcctaaaccctctgacaccttaatcttcccagaataccattgtgatcctgttccactcttgctcaagttttcccagaaactagagtacaaactttataagctttagagttgaaagccactctatctctttttcatccccaggtctctgccaaggcagtataacctgtccaacatctctaacttcaatacctttgtcttagatactagactctcctcctggtttctaattaaacctgatctaggatctaattttgcctctgaattctgttgccctttgccaagtgatctcttcctcctctgagccgcagcatctctgagcttgcacacttagcatagccatagcacacacagccttagcttgcagttcagggtgtttaccttccctccccttccagatgctggatccccagggataggaactctgcccttatgtgtccatagcccctggtagtatgtcttgcagtcgtacattttcagcaaatgtttaattggttaattgaagacaactgtcccatgccttaagcctctctttttgctaaacatgcctgtgtcctttgtcattgaacaactattttgatctattttcttcctgacataggggtcagttccgaggatgctgaaatcaagagacatagcttattctctcaaaattgctttcaagagtgattttgttgtgaattgagaactggctgcctacttttggactacccacttcagcaagagtgtttgaaaccaaatctattctaagtaattttttattcccttttctctatggcattagacacacagctcttttaaactacctttcgttatctattaaacagacattcagtaactctatagacactgtctagctatatgaacttagacaaactaatatctctgagcttcagtttcttaaaatttaaaatgaggacaataccatctatggccggggattaaatgctatgaggaatgtaaaccagatgtcaggtaccatctctctaaaatccagataaaatgaattaaaaatactggccgcaaaccctctctaagagttctcaaaattctcagagagcttaattttcatgctcaccatagcaccgattttcttctaaatattttgtttctaccaaaatattttgtcccaattttgccttttatggctatttcttcatatccactttcccaaactaaagaagcagccccttcaccttaaactcctccttcaaagcaacctaaatacaggtctgggtttgtattcctagtgggatgttacagaggttagtgtgatgcagaggaggagtcatgctgtttaaatccatactagtccccagaggccaggctgcttctgccacccctacccctcccgccacagagctcttcagcttctcacatttctagttcttctctctctactttcattaccttctctctttttttttttcttctcatgtgctcacgggagcagagaaaattaactcctctaagttttcttaacacagagtgccttaattacatattactattgtttgagttcctgccaacactacgtctgtagggtcacacctgctatattagaggcttatcaaaaaaagatagctttctcctaaaaagggatttggatgcctactaagataactggatgccaagataagtttaacctaacaaactttattattattattattattattattagagataggtacttattctgtcacccagactgcagtgcagggatgcaataatagctcactgcagcctcaaagtcctgagttcatgcaatccttctgcttcagctccctgagtagctaggactacaggcatatgctactctgcccagctacttttaaaaaaataattagggatggggtcttgttgtattgcccaggctcgtctcaaacttctggtttcaagcaatcctcctgccttttacctccctaattgttggagttacaggcatgagccacagcactcaaccaagatttaaaaacttttaaaagaaatcacattacttactgttatcatcattatggttactaccagtgttaaaacaattggtattgaaaacaccactaccagatcaagcttcaaaccaagatgtcaagtaaatattattgtcagacctctgagcccaagcctgcaggtatacacccagatggcctgaagcaagtgaagaatcacaaaagaactgaaaatggccggttcctgccttaactgatgacattccaccattgtgatttgttcctgccccaccttgactgagggattaaccttgtgaaattccttcccctggctcagaagctccccgactgagtaccttgtgacccccacccctgcccacaagtgaaaaaccccctttgactgtaattttccactacccacccaaatcctataaaacagcctcacccctatctcccttcgctgactctcttttcagactcaacctgcctgcacctaggtgattcaaaagctttattgctcacacaaagcctgtttggtggtctcttcacacagaccatgtgacatttggtgccgtaactcagatcggggaacctcccttgggagatcagtcccctgtcatcctgctctttgctccatgagaaagatccacctatgacctctggtcctcagaccaaccagcccaaggaacatctcaccaattttaaattgggtaagtggcctctttttactctcttctccagcctctctcactatccctcaacatctttctcctttcaatcttggcaccacgcttcaatctctcccttcccttaatttcagttcctttctttttctggtagagacagaggaaacgtgttctatctgtgaacccaaaactccagcactggtcatggacttggaaagacagtcttcccttgatgtttaatcactgcagggatgcctgcctgattattcacccacatttcagagctgtctgatcactgcagggacgcctgcctggatccttcaccttagtggcaagtaccactttgcctgggtggcaagcaccacctctcctggggggcaagcaccacctctcctggggggcaagtaccccccaaccccttctctccatgtctccaccctctcttctctgggcttgcctccttcactatgggccaccttccaccctccattcctcccttttctcccttagcctgtgttctcaagaacttaaaacctcttcaactcacgtctgacctaaaacctaaatgccttactttcttctgcaataccgcttgaccccaatacaaactcaacaatggttccaaatagcctgaaaacggcactttcaatttctccatcccacaagatctaaataattcttgtcgtaaaatggacaaatggtctgaggtgcctgacatctgggcattcttttacacgtcggtccctccctagtctctgttcccaatgcaactcatcccaaatcctccttctttccctcctgcctgtcccctcagtcccaaccccaagtgtcgctgagtctttccaatcttccttttctactgacccatctgacctctcccctcttccccagactgctcctcctcaggtcgctccccgccaggctgaatcaggctccaattcttcctcagcgtccgctcctccaccctataatccttctatcacctcccctcctcacacctggtccagcttacagtttcattctgtgactagccctcccccacctgcccaacaatttcctcttaaagaggtggctggagctaaaggcatagtcaaggttaatgctcctttttctttatccaacctctcccatctcagttagtatttaggctttttttcatcaaatatgaatacctagcccactccatggctcatttggcagcaactcctagacattttacagccttggacccagaggggccagaaggtcatcttattctcaatatgcattttattacccaatccactcccaacattagaaaaagctccaaaagttagactccggccctcaaaccccacaacaggacttaattaaccttgccttcaaagcgtacaataatagagtagaggcagccaagtagcaacatatttctgagttgcaattccttgcctccactgtgagagaaaccccagccacatctccagtacacaagaacttcaaaatgcctaagccacagtggtcaagcattcctacaggacctcctccatcaggatcttgcttcaagtgccagaaatctggccactgggccaaggaatgccctcagcctgggattcctcctaagccatgttccatctgtgtgggaccccactggaaatcggactgtccaacttgcccagcacccactcccagagcccctggaactctggcccaaggctctctgactgactccttcccagatcttcttggcttagtggctgaagactgatgctgcctgatcgcctcagaagcctcctggaccatcacagatgcttttggtaactcttacagtggagggtaagtccgtccccttcttaatcaatgcagaggctacccactccacattaccttctcttcaaggtcctgtttcccttgtcttcataaatgttgtgggtattgatggccaggcttctaaaccccttaaaactccccaactctggtgccgatttaaacaacattcttttatacacttctttttagttatccccacctgcccagttcccttattaggctgagacattttaaccaaattatttgcttccctgactattcctggactacagccacatctcattgctgcccttcttcccaacccaaaagtggcaactcctttgccacttcctctcatatccccctaccttaacccacaggtatgggacacctctactccctccctggcaacaaatcacaccctcattactatcccattaaaacctaatcacccttacctgggtcaacgccagtatcccatcccacaacaggctttaaagggattaaagcctgttatcacttgcctgttacaacatgtccttttaaagcctgtaaactctccttacaattcccccattttacctgtccaaaaactggacatgccttacaggttagttcaggatctgtgccttatcaaccaaattgtcttgcctatccacgccatggtgccaaacccatatactctcctatcctcaatacctccctccaaaacccctccataacccttattctgttctggatctcaaaacatgctttctttactattcatttgcacccttcatcccagcctctcttcactttcacttggactgaccctgacacccatcagcctcagcaacttacctgggctgtactgccgcaaggcttcatggacagcccccattacctcagtcaacccaaatttcttcttcatccattacctatccaggcatagttcttcatgaaaacacacgtgctctccctgctgatcatgtccagctaatctccccaaccccaggactggcaaattgactttactcacatgccccaaatcaggacactaaagtacctcttggtctgggtagacactttcactggataggtagatgcctttcccacagggcctaagaaggccaccgtggtcatttcttcccttctgtcagacataattccttggtttggccttcccacctctatacagtctgataatggacaagcctttactagtcaaagcacgcaagcagtttctcaggctcttggtattcagtgaaaccttcataccccttaccgtcctcaatccttaggaaaggtagaactgattaatggtcttttaaaaacacacctcaccaagctcagcctccaacttaaaaaggactggacagtacttttaccacttgccattctcagaattcgggcctgtcctcgaaatgctacaaggtacagcccatttaagattctgtatggacgctcctttttattaggccccagtctcattccagacaccagcccaacttgaactgtgccccaaaaacttgtcatccctacaatcttctgtctagtcatactcctattcaccattctcaactacttgtaaatgccctgcccttttttacagtgctgatttatacttttcctccaaaccatcataactgatatctcctggttttacctcaaaccgccacccttaagtctctcttaaagtggatagaagatcttcagtgacaaggtacactccaatactttcaccctaataaagccctattctttacttttatattcactcttattcttgttcccattcttatgccactctctacctctccccagctatctccaccacactatcaatctcactcactctctcctagccatttctaatccttctttaacaaacaattgctggctttacaatttctctttcctccaaaatcaccgagtcctcaatttactcactgctaaaaaaggggactctgcatatttttaaatgaagagtgttgtttttacctaaatcaatctggcctggtatatgacaacataaaaaaaactcaaggatagagccaaaaaccttgccaaccaagcaagtaattatgctgaacccccttgggcactctaattagatgtcctgggttctcccgattcttaatcctttaatacctgtttttctccttctcttatgcagaccttgtgtcttccatttagtttctcaattcatacaaaaccgtatccaggccatcaccaatcattctatacgacaaatgttttaagggaggagaccacccctcatattgtcttatgcccaatttctgcctccaaagaaagaagtaaaaatgaaaaggcagaaatgaaatccacaggcagacagcctgatgccacaccctgggcctggtggttaagatcaacccctgacctaatcagttatgttatctatagattacagacattgtatggaaaagcactgtgaaaatccctgtcttgttctgttcctctaattaccagtacacgcagcccctagtcatgtaccccctgcttgctccccctgcttgctcaatcagtcatgaccctctcacgcagacccccttagagttgtaagcccttaagaggaaaaggaattgttcactcggagagctcggtttttgagacatgagtcttgccaatgctcccagctgaataaagcccttccttctttaactcagtgtctgaggggttttgtctgtgtcttgtcctgctacagtttcatctaacaaccccataatatcaccccttaccacaaaatcttccttcagcttaatctctcccactctaggttctcacgccacccctaatcctgctcgaagcagccctgagaaacatcgcccgttatctctccacaccacccccaaaaattttcactgccccaacactttaccactatttcgttttatttttcttattaatataagaagatagaaatgtcaggcctctgagcccaagcctgcacgtatacatccacatggcctgaagcaagtgaagaatcacaaaagaagtgaaaatggctggttcctgccttaactgatgatattccaccattgtgatttgttcctgcgccaccttgactgagggattaaccttgtgaaattccttcccctggctcagaagctcccccactgagcaccttgtgacccccacccctacccacaagtgaaaaaccccctttgactgtaattttccactacccacccaaatcctataaaacagccccaccccatctccctttgctgactctatttttggactcagcccacctgcacccaggtgattcaaaagcttcattgctcacacaaagcctgtttggtggtctcttcacaccgacacgcgtgataattattatattacttttaactaaaaccctttcagagtctcgcagggaaggctgtatatatctcataaaatgttggggcccactggatcagacaaggccacaaaggccaaagggaagtaaagatctcattatttctcctaataatttccctgtcctttgtcataaatggtgggtaggctgttatggtgatggcagattttctttccataaaatgtccataataggacatttgaacagaagggaaaaatcaaattgctgaagttgaaagagggcaatgcaaagaactttggagaaagaactgtacagagaagtcaactggcagatgggaggaagtttaaggggaaaaatatagatgtctaaagaatacatttattcattttccacagtgcaatttggacaagaagcctctttcttgcttctttctattctcattaaatcattagagctcaagcaatccttctgcctcagcttcccgactagctaggactacaggtatgtgctactatgcccagctaattttttaaaaattagattttaatttggtgaactatttctgtaggaaactacaataatacagcccaggcacattgatcttgggtgaacaaatcagaaggaatgaataattctgtgttcctgggactctgacaatttcatgaacttggtactctgagtaaagcataggaggagttatttcataaaatgtggagcacaatcatgtgacaaagataatgggatccccatttcataaataaatctgaagttcagagagagtaacaactggccagggtcacatcacggagacagaggcagggttcccactgatgcctctgactccctgtcccaggcccttcctcctcccgcaagcagaagtgcagggggcagagctgaccctgtgcagtgaaaatctgagggctgagttcctattggaacacaagtgaaagacttcctggcttctaatctcaggataaggactcagagctccatctgttccagccttaggataagaaccagaatcttacaccatgaaagcatgaaaggtaagatttgagtgaggaaaaaaaaaaaaaaagtctgtgtttcagattcagttcacaaagcagtttcatacttaaggtaccatcacaataaccctgtggggtaagcaaggcaaatttcattcttgttttatgggcataggaagtaagtctcagggaggttaagaccaaggtttctggagaattttatattatgaatcttgatttatgggattactattatgtaattcctaagatcatataggaatcctagagcttgaatatagaactttatttttaaatctatatacatcataattacaaggagtagtgtccatttgggttccttggccctgatgtgttagtggaataaacatttttgtcagggttgccatgtgtgtctgtgcacgtgtgcactgtacacctccaggggatgtaccctaaaccacatgaatgtgatttgcacatccaagatttacagtgtactatagggagaatcttttgcaacagcttttgctataatacagaatctgagatgtctttgagaaagaaaagtgtaatcattaccaaaaaattattctcataatgtgtgcaaatttgtatgaaatctatattggccatgggacaaggaggtatttccagctagcttctgaaagggctctattctctcataagaattcagctgttgacattaggtgatatctgcccaggtcatcagatgccatagagaaagagggtttgctgaaacttatatcagcagtgcactgtatgctctttctgatttatttgaacattcatttattgagtgtcaagtaatgcactagatactccagggatctgacacaaactctgccctgaaggagcatgtaatctcactggggagaaaacaaaacatatgataatttcaaaataacaaactaggcaaactagttaacacttaaaaagcaggctttattcaaatgcaaaattgcatgttacagggtaacctttcagtaagaagccaggaagaggagctcatcatgggttggattagtaaaggactagttataaaagaagtggtggggttgagggaggcctgagatgaaatttaaagaatatgtagaatctaggtaagtggataaaaggtctgggggcaggggaaaggagagcatttcattgtgaatcaaggaatttctccacctgttttaactcttccatatgacatcaaagagatgtcacttgcagctagcatttcagtgatgttttcttactaataatatcgtgataaaagaaacattgactataagaaataggaatgggtctcataaaaggaaacagcaaaacccccaaactaaaaaacagcgcaggctatttctctcttctctccttttgcttggcactcatgagatgctaggtgtggaagtcagccaactgaaaaagagaggtggctgaagaaggtggggaggctgaagccagttaaataggatggtccaattcacagacggcgaggctacagtgcaaataggactctttcaacttgagcaggaccccattacttcactggagttagaaagaaaggagagcgtagactttttgaactttctataagagtgtacctccacagtatacagaagacgacgtgaaatttgatctgcaagaaaactgagtccatattcacatatgtatcaaatttgcacttcatttagaagtgtctgtcatcaagtacagcactgaattgaaactgaaaacaagagtcaagaaagagcaaagtcagccatctttatattccacatgaatcctttccctttatggtcttatttgtttctcctcagaaaagacaaaaagctgagctgtataaacacctgtgggctgggggttgagggataaatgaggggcgaaatggaagctgaaggaactgttggtcaggtagaaatcttcccagatgcactgaaggaaacacacttcatgtttgacgtaggaggtgccaccacacaaaacgtttcatggaaggatttaaaggatctcatgatttttagtattccaagaattttctttcaccaagggcgatttaatatgggtcattcatactgaaagaaaaacaaaagataataagagtttaaaaattgcaaaacttggagtgttagtagtaaaggtaaatattcattagagatgagaagaggagcaaggaaatgctttcagctggaaatctcagacaagaggccaggctttaggaacctctgaagatgaacaaatgtaagcaaaccctagtagcagcacttctcagattttcatgtgcttaccactcagagatggtgttaaaatgcagactctgattcagtaggtctgagtggagcctgagattctgcacccctaacaagctctttagtgatgcttatgccactggcgcacagaccccacttggagaaatttttgtggtgcatacggtctttgtctccagatctaatgagtctgaaggacagtgtagattgattttttaaatttatgtttattttaatttaatttaatttaatttatttatttatttatttttgagatggagtctcactctgttgcccagtccggagtgcagtggcacggaggcagctcatgcaaccacggcctcctgggttcaagcgattcttccgcctcaacttcctgagtagctgggaatacaggcacgtgccagcacacccagctaatttttgtatttttagtagagatggggtttcaccacattggccaagctaatctcaaactcctgacctcatgatccacctgccacggcctccgaaagtgctgggattacaggcgtgagccaccgagcccagctgtagattgattttgagcagtggaaagtcaaggaattagaaggcatgcttaaatggaaagtgaaattggagaaaatttaaactcatgaaatagtggtggttataaactcgtgataaattatatcctgggatataatttaatgagatggtaacacatttagtttaaagaaataagtgacactttttttgtgtgacacaactgtcttattcttggaaaggacaaggagagaatgaaatatggtatgtcttcacagcacctttcaaagggagaaccagattctgaggagctggtctcatgatgaactgtcagggtaaaccacagttcagcagctgcaaatgtgcttgccaaaatagagacaaaaaaatgtttctgaaaacaaaatttcacatatgccctcctctgaggttggcatcatatcttcctgtgtatcttgggtgtagcttctatcctgccagaatttagacagtagaaaccaaatgaggtgataaacagagtcattttgcagaagagtcaaaataacccagcaagaaatgaaaccacaaatgcccaaggagtcattcattcaccattcaaaagctaatagaaatgaacacaaactactatgaaaattcacccaagaacttaaaaaaaaaaaaaaaggctcatggtgtttagtgtgatagtattcattttacctttgacttgttctaaaaacacaccatacttctaccccacccttcctcagtgccgtcacacaatggtttcagtgtgaaaaaaaaaaccacgttactggaaaaggagggtgcctgggacttgccactctaagctggtagtcaagggtcttgagttctaaaagcatacgcgttaagagcatgattcctggatccaaatgagtatggatctcagcattgccatttattgtgacctcaggctattttatttctctgtgcctgtttctttatcagtaatgaagatgttcatagacccttctcccacagacttaaaggcatatttcatgatttaagacatgtaaaccattcataacagtatacaacatggaattaatatttgataaaggtttatgattattgtaactaactctgtcacttgctcaaggcctatagaaaacttacttaattagttcaactacaaaaagagtttgaatgtgatatccaccaagatcatattcagacctagaattctgtgattcttatgaattaatacagccttggtcaataaatgagagctgggcaaataattcttctttgctaggcctttctagaccatctggtgaagcattcaagacttatgttattggggccagccttcctttccaacttcaactccacaactcctcaataagccatgggctcaagaaagttctgctcagtggcccctgaaaaatgctttcatagtctcactaccataccactgcttacacaatttccttcctacagactgccttcctttcctgcttttctccatatacctaaatcctatctattcttcataagcaaccttctttataacattttctataaccaccaagccaaatgaccttttccttcttaaatatagcacccattggccattaccatgctctgccttgtatttttctgatttttttctttctatattcctgtcttaactccccagctaggtaataattttcctgaaatcagggaccaggctgactcctcttgctgtctcaagaaagcttagcagtttccaacacaaaaatgttcaataaacaactattaattgactgattataaaaaatcagtgaaccattaaacttaatatagcaatttgcttagcatggtaattagctttttgctaatattcttccagccagtctctcctcctgtgcctcaaggacatcttaaaaaaaaaaaatctagttgatctgcttccatctagtggcaattaaaacaggtggttccggtagccagaaaacagctctgggtagattgtgccagaaaatactttcactcagtaggtgcgagtttgaaagaaatcttcacatctgtgggtttcctgccacagacatagggagaccagcccagagaaagaagcctttcctcactagactccatttgcactagtaaagagaagacagagtaattaaaaagaataaaaagaacctccactgatcgtacatcctcatccagttacccctgccccacttctccttcacagccaaacattttaaaagagatgactgcttgttctgtctctactttctcatcctcagtaatgctcaatgcttggccgtctgacctctgtcttgatgtctgcactgcaaatagtctccccactgacacccttgttgcatccaggggatacttactggttctcttggcaatgtttgaaaccgttcccctttctttgtttccttggcattcattaccccacactctttctcctcttccttctccctgcctggcaacatcttttcatttctctttcccttaggtgacttattagataatgatgttcctctggctcccatactctctcccaggtcctcttccattcttaaagcactcacaccctccctggatgatagtacccactcctgagatggcagttacctcctgaaatgtgagggacccaaatccacttctcctgccatagcctctgtgctttggataggtccaatgagccacagtgaatgatgtgcatacacccaaagctcagtacaaaactgaacccatgatctttacctccaaaacctctcattcttttatgttcccttctcagaagtaaacaggactaccatccgccagtttccaggtgagaaagatgataatttgattcttctctctcacttttagccaattaacagacacattcagttaatatcacctcctcttatttcatgaacccattcttactactagttccctagacaggcgccatcggttttaatctaataactgcaaatgcctccaaaacaagtctctttgaatccaggctcacctgtctcccacacttgccatactgctctgcagggtgaccttataagatgccagaggtaaggctactcactgtttaaacccctttagtgatatcccaaaagacctcaagataaagcccatatcacatggcttatacattagtttatgatctggcttctggtgcctcatttttccccactttttcctttgcattctaagcaatggcccatactaagtttgtgattggtaggatggttgcccaaaccagcatccaatcccttcagaaatcatctcacttcatttctagcattttaaaggaagctcagttgtccagctgggtactgaatatgtcaccaaagtcctcctttcatagtttattttacttaaactctccttcctaaaattccagagcaagtcactaaaccctagatactgagaaatatttttccatcttcatttctgccaggtgggccatcaactttcacatgtctgcatctcctcccactgtgctatttctccagtagaagaaatttgagcttcaagaccaaactgaaaaatacttgcctccttggggaagctgtaggtagaattcatgctccctatctttcccacatttctgaaggacaatgcctgttagagcaattgaatgcaaatagtcaattgaataagcatttattcatttctcaataagtgcttgttcaattgaatatttcttaaataatatatttaagaacaagaagaacacaccacaatgtttttaaccctcagaaaaaattctgaggtaatcagaaaaatctccctttacataaactgcccttttctaatagggattacttgttcgttcattcattcattcagctccactagcaccaaaaagcacagctctgaaaggaagctagtagatttatcaccttatctggtcatttggatgaggaccccaggtaaataaactactatggggttaatgtgtctagctagagcaggaagtaacttaaggaagtagagaatgaatcagcagatgtggaaactcctcgccactaataaaacttaccttctcttggatttcttgcctgaaaatagaaaatagagaaaaggcattagcaaaaattagacaatttaaagtttttcaagtaagggagaaggaagactcccactctcaaaactgtcttttgaagtatattaggtatttgttaggtggaccctatctgtgtcaaaggagatttgaggaactggcttaataaacagtggtagacactaatacagaacagacatgttgatgcagatgcctcctgaggttccattccattctccgtgctactcaagaagacagaattgctaaattgcctggtggcaagacccaatatgtccattcaagtgtttatcccttcccaatctgccatctcatcctacctgcagattcttcccttgagggacagctgctaatactgtaaaactatgtgccattacagctcacagcatcatctctatgagaatccacaagagaatttcactttggtcttgttggtaggaattgtgcagcctcatctgagtaactaatgtgtttttatcttacaaacacaaggaatatcacatggttctcctttgactggctgtaaggaaactcagagctagatctgagaccctctcctaccaagtatataaaactttgtgacatacatttttgtgccataacttcaaccttggttccaaatgatttttgtaccctaagtttaaatttggctttcttttttttttttttgtactcaataaaacatcaagctcatttattattgcgaagagcgaaacaacaaagcttccacagcgtggaaggggacccgagtgggttgcccaaattggcttctttttcttactttttaattaattttaatttgctatactgaacacattttgtactgttctcacattctttttgaaaaaagcagaatataaataagtagataacttaaaaaaaactctttgagcagaaagaatcatttgggaggcaatatatttcagtggctgtaaagtggcattctagaatcatcctacccaggtgaaagccctattttgccacctgtagtgtagtgtgtatttgaacagctactttcttttctaaactacaatttcttcatctgttaaagaggcataataattgtatcatcctcattgggttgataaaataaaatatttccaagtatttagttcaggtcctagcacgtagacagtgttgcattactgttttaatcctttaaagtattaaagactactatttgaaatcttttcttctaaaattcagcctgctgatgaccaagtgcacttgagcagggggaatcaaatctgaattaatttcagattctggttagcttcacataaatattttttttagggatgatgaacctaacagcaatagatgagtaagaatctgttcctactgagagagtttcattttgaagaaaaaggaactaagggggcatgtgttcagtttcatgccctggtctaaccctgtgtgttggttctggtgggaaattcttccaaccgaggaaaaaaccagttcacaaatctgaagaccagtgattttagaagatgtatctggactggagtctaatctctgactctgggtcctgctgatatggtatttttgagatttggcctaaaacatcattgccctggtttccttatttaccaaacagggccaatggtagtgactaatcagaaaatgataatgcctggtgcacaaaatgtgtctagatgagcccatgcacaaggacacatgtttctggaactgttccttattcctttcctaaaagaaaggagggaaagtctccatactaagactactagggcaggggacaaagtgctagagtcagaagattcatctgaggacagaagaataggggtgaaggctctagtcacttcattggctaccatgctctaaatagttacctgtgccctttttctaactattagaacccaaaaagcctataaattctctctctctctctctctctctctgtgtatatatatacatatacacacacacatagacacacacacacacctaaacacacacatagagatttatgactttttacttttatccttgtaaatgccattaactatattttgtcttagatttagcctgggaatgtagccattatttctaccattgcctccataggaaaaatactcttcatgttttaaaggaccaacctacaactaaaatctttggaaagcagaatcatttgtaagttggtgaaaatggaagatgttgttttataaatgaagactttttttttttttttttttgagacagggcctcactctgttgtggagtgcagtggtgctgtcatggcttactgcagccttgacctcctgggttcaagtgatcctcccacctcagtctcctgggtagctgggactacatgtgcatgctaccatgcctgactaattttttgtatttttgtagagatgtggtttcgccatgttgcccaggctggtcttgaactcgtgggctcaagtaatcctcctgcctcagcctccaaaagtgctgggattagaggtgacagccaaggtgcctggcccacagatgaagactatttaatgttatcttaaagataccctaagcttcctaccaagccagtgatcttttggggcttctgttttctttgttggcataactgtaactagcctaactgcccgttatctgtttcctgtttgccccacactgattcccacagcagttttcaagttatcggtttgagatcttgtacagaaatgactccaaggtaaaaaatttaaaaacaacccctctaatttttttacccttgcttataaaacagccttagccagctaacccctcactacatgcaaatgagtttgattctattcttttgattctacaaacacttattaaaagattttagaattcggaaataaatagcttccttattaaggtgacttacagccccaaagtccttaaaattatttagacaatagccaccttatcccagggggcagtgtgtaataacccaccctgttctctatccgtcagttctgccatcatcgcccaaggtaggaagaaagacaggacaaccggggtcaagatttgaagtctcaatggaaagaataatcagtggttggagaaaactgtcattcttcttttgccttaatgcagtacttgatacttatacttagtactgtatagtacttagtactgtataatactataagatagtgagattcaatcagcacagaatttctaatagcaagggcagagacattttaactgctcagtgctctcaggttatacatagctaatgaagttcttgcatatcaacaatccccacccccctcacacactttgtctttctggattggttagaaaacttacctagcgcccactattctcaaatttaaatgaaagataagatcagagtggcacgcaattagggactgataaataatatttttgtaattgccagtgtaaatggacagggggcaacctttacataccatattcagtgaacagaatacgtactaactaatttgatggaaggaaaattaaaatgacaatcaactgagcccacagaaaggcaacacagagcagttggttagcaattgtttcgagatcatccctgaacttgaaacaggtatatcttttttttttttttttttgagacagagtctcactctgtcaccaggctggagtgcaatggtgcggtctcagctcactgcaacctccgcctcccgggttcaagtgattcttctgtctcagcctcccgagtagctgggattacaggtgcccgccaccacgcctggctaatttttgtatttttagtagagacagggtttcaccatgttggccaggctggtcttgaactgctgagctcatgatccgcccgcctcggcctcccaaagtgctgggattacaggcatgagccaccacacctggccaaaacaggtatatcttaaaagctgcccaatgtccatgaatgttacagccttgaatggttcttccaggtgagtttggccaaatgtggcaccatacacccaaggcctgctgcaggctagtgggttgctcacactttaaagctgagacacactcatgccttaaggtaaagggagtgataatctgggcagcagatgttaacttctcaaggcagtcctccttctcttttcctctccagtgacggatggttggaaagcatatatggtgcatttggttagagctgtggccttggtgaatagatacttgggagaatacatgggaatttctcccagggttaatgcaatgcccatgtgttgggaaccaggtgactcttgaagaggtcaggtatttgggagcagtgccttgaaaccttagtggacattagacccacttcctagtggaattgtagcattgaaatccaaggcatgtaggctcttagaggacagagatagtgtgtcattttttcagaattaattaagagcaggccaggcgtggtggctcacacctgtaatccaagccctttgggaggccaaggcaggcagatcacgaggtcaggagatcgagaccactctggctaacacagtgaaaccccgtgtctactaaaaatacaaaaaattagctgggcatggtggcacgctcctgtagtcccagctacttgggaggctgaggtgggagaatagcttgaacccagaaggcggaggttgcagtgagctgaaattgcaccactgcactctagcctggtgacagagtgaggctctgtctcaaaaaaaaaaaagtattaaagaattacataagagcaaagaaccattagaatatctcacttagttgttatcagcctagcaagctgccttgaaggtaatagacatttttaaaagtttatcagatgaaaagcgaaaatcagccaacctgttttaatgaaggtgtgtcctgggctgatttacatgtctccagggactgatggctctagaatgtaaagcttggcatcctgcttgtgttgaatctatcacatttaatttcctgtgggtttcttttttttttctttttcactttaaagttgtgttcttttcatgtgaagttaaactcacatacctttttttaatctccttgccagccaaatgataaatgccaacccagagaatgcagtaaccatgactgccactggaatgaagagggggttataatcaccctccttaatcattgagaaacttttgtccaattctgaaagagaaatcagtaaggcacatagcatgagaccaccagcattatttccttagtctatctcatgatatttgacttttttcctccttacatctcccagtagtagcccatttgatgccatttgacagatgaggaaactggcatgggaaggcccctgatgagtctacagcataggcaaagactggaccagccttgctagtctaatgcctacagaatctcaatgcccagatttgtggttcatagagttcctgaaaatgcacctaaaaatgttggcaagaatggtcatcgttgtatttagctccatggacttgttcaatgactggaactctgaaacacagagaagagctaaaagcctaatacaacttcaggaaaaataaaagccaatgatctgaactggataattcaccagtcaaaggaaatcattaatgcttttactttaaagcagttgtgcaaaaataagcacttgatttttacatgccaaggacctgcactaatttctttccaatgcagtagttaccacttccctctacttccttcacgaataagtaaaagggcatgtttagagatactcttgtaagtgtaaactaagttcatttgggagcctctatttgaaaatactggtataaaaaaaaatctgtctcctgatactaacatttgaaggaatctacttttttacatattggcagagggtctgattctatccttagttcttcccattactttgatgaaccttttcaaggtgatttgatccccacacccaaatatatgattgagagaaggctcaagttcccaggagctccagacagaaggtacctgttggcttgatgaagatgaggaggaaatgaacactagctaggccttaaagggaaatgtctctgataggcctaatacacagtcctctgctaaaggcctccctgcctctctctgctcatccactctactccctggccctgggcacgcagcacacagagatcagcatttctgacagcttctgtagatcctaccatttaaagacttttgtcatccatgcagatagtctcaggagcagacacaggtagctattctttcacatgctagcttaacatgcatttgctttagcacctattgccaggcactgtgtcaggtggagggtatacaaagatgaacaagacatgattcttctcatatacagatagattttggaggcattagcttagtgatgattcaggagtatccattatttggggaagtaggtggtcattagtgaccttttacaggcatttcaatgggctaacagagatgttagattgtagtggaatagaagaatgggtaaaaagtaaatcagtgagttcagattttaggagttaagatggcaagaggtgagaacaaaaaaaggaaatgattgtcattaaaggaggaggaaagaccagccaaagattttacagtgagttaagcatacaaatttatttctaggccacatattcttagcaaaacaacatgtaaatgtttatgtatgtctttcctcatatctgctcatccatcagctccatcgttaagatttcagttttccaggacaaacttactcactttgacatattggactaggatttgaccagattccagatgattcacaaatggttttcttcttcccaattaactcagttccttctgagcagatgaaggtacatgcagaggtaaagctgaagctggccaggggatggctacagttcatgatccccaaatctggtgctgatagaggctcacactgaatcacttcaatgaaaaagaaaaaaaaaaaaaagacaaaacagtatttctgagtagagaccctcccttgagcaaaggatttttagccaaagctgcctgactacattacttgtgatattgcttccaggctttattttcttgagaatgatggtgggtggtgaatgagagatgaaggcaaggaagcattgaaagctgtggggagaggagtagctactccaggctgctgccctagctaaggtgaccctccccttctgctggaagtaccatgccatatggcctctgcatcaagggctcttatgggatattctcagagaatctctgccgtttcatctgttctgatatctacccaagcattttgaaaaacatcccaattcactgaagcaagtccaacttccgtaaattccagtaggtgggttgacagttttataatttcaataagggattttgatagcacttctaagaattaaactacttaaactaatgcatcaggagcatacttgtagaaaagttaaccaaaacttcgtaagttcagatgacattggttttctcccatatggagataaggttggcagttaaaaatgaaaaaaaaaaaaaaacctaccttatttcaaacttgaaaagatcaagagattgtgtttttgtttttcagttgttattctcctaaaagtttatgcatgaggaaaagtaaaagtgattttaagaataagccaaataaaacaaccaagaaagacctccactaccctgggaaggaaactggttggtattaagtaggacaccacataaaacaggtgttattgagaggagaagaaccaaaatgtaactgaggttcaacaagacattatttatgcaatggcaatgagaaaaataaaaaacacagtataaccatgctgtattgctataagtcatgttacacactgggagatggcttcaggggtatttggtttttactttttgtttgggaggtttttcaaaaaaatttagttagaataagtcctttgagaaacatcacagtaggttaaacaaagttaggttaaattaggctcctaagtttgacttctcagcaaacttctactgaatgttctgactgtaagcccaggattgcatgacaaaacctctagtctgaagttactcaccttgacaggttggttctggagatgaccagtttccaaatggtccacaggtggtttcttcaatcccagttaagtttgttccttcagagcagctgaaggcacactgtgagctgaagctgaagtttcccaaagggtgagtacagtccatggtacccagctctggggcctccaaaggctcacactgaatcacttcaatagggaaagaaacagtatggggaagagttaagaggaactgacgcctggatttgaatcctagccctgccacttgataaccatgtgcctttaaacaaggttacttgaaccctccaacttcagtttcttcatctatataagaggaataatgaaattgtgttatctttatcaaattgatatggaaactaaatgtaattcaattagcataagtcaaggaccttagaacaaagcctgactcatcagaaattctaagtaaacattagctagtcttcatattattatcttcagcattatctgtagtgagaatccttaaagccaaataggtgtaactgggaatgaccagcttagtcgggaaataactatcacatcagagcccctgagtctactagagtattgggagcaagatgttcagagaaagagtgggtctccataataagccttctttgcaaggagagaatataaaagtctaggaagcattttgacctcaattctgtcttctattctagctcagttccagaattttaactcttttgattttgacaaccctctccagaaactgtatctatttccctgttctgattggtggtacaataggtaaatttaagacttggaaatcaaagttttcacattttagaccctgccatgccatttagtaaacagtacaactttcatgtcttattcctcatctgtcaaatttaagccattattgctaccttgctctagagacttcaaggaagaatggactcaaggaatcagaagaatttttgtatttggaaactatatgagatgagattagggagaaacatgggaactaagagaaaatgttatcttttttcattgatttaaagagtatctattatatatcaagcattactctggggcttgaagagcttagatttcaccctgtaggacaaaatggtaggtagaaattaatgggtggattgtcatgtatgtgtgatgtgttttaattgcttttaattgatcagtctccctgtagtatgaataatgtatttgaggggagctaatttaaaattgtggaactcatctaataaactattgcaagaatctagaagaaagataatgacggcaatggtagtagagttgacaagtggaagacaaattagaaaaacactaagttgtaaaaattggtagaatgttaccctgcataaatgttgggggagttaagagagtctcataccagggtgcccatgtaaatggtgattccacatactgagataagaaatacgaagagaaaagctgactgggaacaattggttttatagtcttttaaacatcccaaaggacatccttagcatatttgagttcagagctggagataggcttatcagtccaaagatcacatagatttgtgagtccgcaaaagtcagtaagtttgaccaaaggatacatgtagattagagtcagaagagcaatatacaaaagacaaaagctgagaaattatagtagtttatggtcctggataagtgctcatgaaggatctcaggagaaatgatcacaggtagaaagaatgagaaaagagtgatatgagagaaaccaagacaaagaaaagtaaaatgttaaaaatgagtgaaataggcataccaataattaaaaatgagtaaaataggcataccaataacataagggttaaaaaatagagttcaaaaatggggtgagggtaaagtattaggaaggagtcatggcccagggatcaagtgaaatgagttagatctatagatctatttcagttggttgacatttaaatgtattttggttttaattctttattgtttacaaacattgcttttttaaaaaattaaattgtccaattcaattcaggctcacaagcaagtgcctcatatatacaggcattttgtggatcccaaagatgcaatgataaataggacacttactgatctcaagaagttttcagtaccagaggagacggacaagtgaacagatgacttcaacataagtgggagaaatgaggaagaaatatgtggagctatcagaactaagaaagcttcctagaagaaactgtctttgaacaatgtcttaaagatgacatgttttttggccatgtgcaaaatgagagagaaggccaccagcaaagtcagtgtgctacagagcacatgtgttaagtgtggagaactgcaagaaggaaaggaactactagaaggaaaaagcaagatactttctgggtaactcagcctcctaatgataaatggcatagtttcttccagaccttagagttctaattaatctaacaagctcattagatcgtgagcttcttgagagcgggaatctaccatgctaattccttatggtaaccctgacagcttttatcccaacactgtgcttcttgtggtactcaaaaagacttgttgagaagtgagtcgaaacttcatgctgacttatgaaatctttacggaaaggtaacaatattgtgaaagcagagctttctgatcaaaacttcccatttctcagagtggctagtatcattttgttccaaccagcttcatgataagctataatgattcctgtgactttacctaagaagaagcaaagaaaggaaagagacttaccaaactgacactggggcccatagtaccccacatcacagttgcaggtgtaattattgatgatttctacacattctccatggccactgcatgaccagggctggcaagaagctttaaggaggtcagaaaaaaaatattttaatgtgattacattttagtactcaaagtcatttctttagacatagataaccttttgtctgagatgatttaaataatcaggaaaggtttatttgtaaattcatagcataaaaatcatatgctaaaatttttacgtataaaatacactaagcatatagtcataggcatttatttgcttttggaatgaaattaccaatactaatattctgtaacacttataggaaacttagtggcataccttgaaactcttgaaattacttgtttttaatgagtgagaaggttaaatgatgacctgacctcaatcatttctgcatgcaattatttcttggcaatccctttctttatagaaatcaaagattaaaaagtccaaatttgctaaaacggtagagtccaatttataagagaccaaattaactatggttcattattaaaacatcacttggaaaatgctggctgttttggaattgtagaagattttacagaaatattcatacaccaaagatagtgcaatttttatataaaattatataaggttagaccaagaaggaagcacgcagcaccacactctctacttcacaatgtgaaaactgaggtgatgtgagcctaagtttccaactggccccagctgtcagcttctcctcccctgccttattatcaaaggcactgattgtctagctcttcctctgtacttcctacgtagatctatcattttgatgtaacttgatttaggggtatagcttttgtgcacagggacaaatcttacacaccaaaaattcttaggagtgacacgatgcaagattatatagagggctagatgtattttagaatgaaccagaagctgttctcatccccccacctttccatggggtaaatctgagtattctcttaaccgtggcccttcctgagtctgaggcagcatagccgtcttgtcactccctacctgtgtaacagagggctgcctttagtttgtggcaggcgtcatcgttccatttgcctgcatctttgtttctcttgatatagatctccacgcagtcctccttgttcttcttgttgttgggctcaccatctccccagttctctgcttcttcagtaagagatttgttggttcccacccacgtccatattcctcctatcttccggattcctatccagtagtaagaacgactgaaaggcagagtcttctccagatactcaatttccgccttgttttgtatggcaactaaatctgtgtaattgtctcggcagaatcttctagccctttgccagttcatgggtttttcagaataatggtaagtccagcagtcggttccatgatgtgccaggaaatctgcaagacatcagtgtgacctatgcagacttacataatgttacagctaaaaagaacctagcactactccaggctgagctagacacttagagatgaggaaacagagcctaagagtgtatgtgaccatctcaggatcacagaatagttgtttgcagatttgaagtagaacctagaccttctggcttgaatataagatgcttttatctaaggttctatttgaaacaaatttagtggttttctaggtttattttcttattaatttttttctcaaaattatttcaggtgaaatttaaccaacatattttagacattcatatttctttttctttgtagctgttaatgatttacaactaattaccgtgtaatatcatataactatacaatttacgtatactttttaatcctggaatcatttcttgaaggccaacacatatgtacctatgggagaagcataataaggacaggaagaacagtgacatacttttaagtaacctcttttacataaaaaacattttattttaccataggaagaactgcttctggaaaagcccaatataccactcaactcttatatatctaactgtataatttttaaaaagaacaatttacaaagccaaatggtataggattatgaaattcattagatcatgttctatacacaaagagactcaactgatgatgtttaataaacatatggacccatcaaatatgagggctttgaagatatctaattaaacacataattacacaatgacttcataataatatatggcattctaagcatggtatgatctacatgaatcactatttaatacagtaaagaaacagatataattgatggtaaagagcatcataaaataaacattttgaacagagttttgaatgagcattccactagaatgcaagttctaagagggaaaaaactgttgtgtccactgctgtatccttagtgcctagcataaatttcacacattgtagggactcagaaaatacctgttgtatgaaaagagcactaagtttctatgtgacacagtgcagacatggcataaggaatgtgtgaacgggagagttagcatgtttgcttggctagagctgaaaatccaggctagggagaaagaagacattagtttacttaggaaatgaaaaaccaagttcaaagctattgctggagagtcttcaagaatcagatataaaatttgtcacaacaatgggagaaggaccaaaaaatgataaacccccgtcccttaataagctcgtattgtaattgtagaaatgacattaatgtacactgaactatgaataaaaaatagaaaatgaggtgctaaatatttggtacagattgtaagtaccttaacagagatttcttaattaacattattcctttataattgagggattttgtggggttattgggatttgaactctacagcatgggctattataggttaaaaatagtgttcaggagtttctggggaagaactaaaggtaagaagaaaagagatgtttacagaagggatagaattaacagctctgtgaaataattttcccttagactatgtataactagtggatatttaagaaaaatgaatataagtaaaatagacttagcgatatataaatatcataacataccacaacagagcattgtccacccccacaacttgaagatgttccataagtccctctgggtgctctgacatttccatggaaatatctgcaaatgaaatacaaaattatatttagatgtatactcttaaaccacacatttatagcctttgaggtggtgcttacaactttcttaataatcagaataaaacacatatgtctactaaccctgtctgaggtaacaggtttctcagacatagatgaaaaattacttcaaatttacatcagaactgatgcacagttttgttttgttctattttatttttacgctttagtctcaagttgctaatcggtactgccctgaattttttctatggtttggtaatttttatacctgcttttctgctgagctattagataaaactatttaatatttactatgtatattttttaaagtattgttgctgcttaattaactattgatgcttatatttaatgttatagcctcactcttgatcataatgggtcaatgcctcaaatacctaaaaaaaaaaaaaattagatagccagacaccaggaaagaaaagtatttctttttttaataaaaagaaatacctttttgagcaactgaaatgacaaagtcacaaatttcctgcacaccttaaaatatacttaatgtaaatgacgagttaatgggtgcagcacaccaacatggcacatgtatacatgtgtgacaaacctgtatgttgtgcacatgtaccctagaacttaaagtataattttaaaaaaattctatcttccaaagcatatcacttctcaggtagacacagtgtttattgcaaaagatctgatttcaatagtatttcttcaagagtctccccagagacaaagtcaagaagaggaaatcagcatatctgagaagaaagatttcaggatcactttttttgagggtctgagaaaatgtttagtttctatattatttaaaaccagaattgaaatggggtgattcctatccttgccacctgcctctacaaccccaagagtttctatctgagcatctaaacgtcttttaggctgaaaggctcaccatggctttgcttggtccttctctagttcttctgcagcccattgagcctcttgacttagcacaagggtctcaggtccttgcccaaagggagtgtgctgtgctgcaggtagactgcactgaatgtcaacagaaagccttgctttctttcatttctctaacccagtctcacatcctcctcctcctccccttttccctccccttcctcctgcacttctctttcctctttccccacccctttcctagactggcctctattgcctcccactgagacaaaaatgaactgctgatcagaaagtaatgtgactagattctctcttccttccctcctttctatccttccttccattctcctatgcatctttccttaccctcctcctccttcactcattgttgttgctgttcttcttcctcttctttttcctcctgctcctcttcttctacttgttcttgttcttgtttttgtttggttcttgttctcctcttcctccttctctctctcctcctcctccttcttttccaccaccctcccctatctttttcataaatgctaaactaactcttggctacctgtggtaaatggcccttggaaattgcaaatactacaaatcaaaactgcatttcagacatatttatgatgtttgcaaaacttcagtagagctaagcagtggacttgactcgtttcggttccttcacctccgtctttccttgctcaccacctagtggacgtccttgttagtggcacttcctgaagttaacccctgaagagagcccatgctctctagcttttcaccgtgtaggtttgggagcctacaagtacctttaatattcttggactataaaatgagatggttttataagactgcatgtgaaattaggacccatatgatgaaggacaataaaaaggaagacccactgatgtgagtcaatgagtcaaatgcaaatcagatttgcatttttaggaaaataataataacaacaacaaaaactctgaagctcagcgccccatatttattatattgtttaatctttataacagctctctgctatagatatgattattatccccattctaaagagtctcaaagaggttaagaaacaaattcaaaaactagcgaaagacaagaaataactaagatcagagcagaaccataggaggtagagacacgaaaaagccttcaaaaaatcaataaatccaggagctgcattttgaaaagattaacaaaatagatggaccactagctagactaataagaaagaagaatcaatagacacaataaaaaatggtaaaggggatattaccactgatcccgtagaaatacaaactaccatcagagattactataaacatctttacacaaataaactagaaaatctagaagaaatggataaattcctggacacatacaccctcccaagactaaaccaggaagaagtcaaatccctgaatagactaataacaagttctgaaattaaggcagcaattaatagcctaccaactaaaaaaagcccaggaccagatggattcacagccaaattctaccagaggtacaaagaggtgctggtaccattccttctgaaactattccagagaatagaaaaagaggaactcctccctcactcattttatgaggccagcatcatcctgatactaaaacctggcagagacacaacaaaaaaagaaaatttcaggccaatatccctgatgaacatcattgcgaaaatactcaataaaatacggcaaactgaatccagcagcacatcaaaaagcttatcaaccacaatcaagttggcttcatccctggaatgcaaggctggttcaacatacacaaatcaataaacagaatccattacgtaaacagaaccaatcacaaaaaccacgtgattatctcaatagatgcagaaaaggccttggataaaattcaacaccccttcatgctaaaaactctcaataaactaggtattgatggaacgtatctcaaaataataagagctatttatgacaaacccacagccaatagcatactgaatgggcaaaaactgaaagcgttccctttaaaaactggcacaagacaagtatgcctctctcaccactcctgttcaacatagtattggaagttctggccagggcaatcaggcaagagaaagaaataaagtgtattcaaatagaagagaggaagtcaaattgtgtctgtttgcagatgacatgattgtatatttagaaaatcccattgtctcagcccaaaatctccttaaactgatcagcaacttcagcaaagtctcaggttacaaaatcaatgtgaaaaaatcacaagaattcctatacagcaataatagacaaacagagagccaaatcatgagtgaactcccattcacgattgctacaaagagaataaaatacctaggaatccaacttacaaggaatgtgaaggacctattcaaggagaactacaaaccactgctcaaggaaataagagaggacacaaatgaatggaaaaacattccatgctcatgggtaggaagaatcaatatcatgaaaatgaccatactgcccaaggtaatttatagattcagtgctatccccatcaagctactactgacttttttcacagaattagaaaaaaactactttaaatttcatatggaaccaaaaaagagcttgtatagccaagacaatcctaagcaaaaagaacaaagctggaggcatcatgctacctgacttcaaactatactacaaggctatagtaaccaaaacagcatggtgctggtacaaaaacagatatatggaccaacggaacagaacagaggcatcagaaataacaccacacatctacaaccatctgatctttgacaaagctgacaaaaagaagcaattgggaaaggattccccatttaataaatgatgttgggaaaactggctagccatatgcagaaaactgaaactggatcccttccttacaccttatataaaaattaactcaagatggattaaagacttaaatggaagacctaaaaccataaaaattctaggagaaaacctaggcaataccattcaggacgtaggtatgggcaaagacttcatgactaaaacaccaaaagcaacagcaacaaaagccaaaattgacaaatgggatctaattaaactaaagagcttctgcacagtagaaaaaaaaaaactatcatcaaagtgaacaggaaacctacagaatgggagaaaatttttgcaatctattcacctgacaaagggctaatatccaaaatctacaagaaacttaaacaaatttacaagaaaaaacaaacaacaccatcaaaaagtgagtgaaggatatgaacagatgcttctcaaaagaagaagtttatgcagtcaacaaacatatgaaaaaaagctcatcatcactggtcattagagaaatgcaaatcaaaaccacaatgagatgccatctcatgccagttagaatggcgattattaaaaagtcaggaaacaacagatgctggagaggatgtggagaaataagaatgctttttacagtgttggtggaagtgtaaattagttcaatcattgtggaagacaatgtggcgatttctcaaggatctataactagaaaaaccatttgacccagcaatcccattactgggtatatacccaaaggattataaatcattctacgataaagacacatgcacacttatgtttattgaggcactattcacaacagcaaagagttggaaccaacccaaatgcccaccaatgataaactggataaagatgatgtggcacatatacatcatggaatactatacagccataaaaaaggatgagttcatgtcctttgcagggacatggatgaagctggaaaccgtcattctcagcaaactaacactggaacagaaaaccaaacattacccattctcactcataagtgggagttgaacaatgagaacacatggacacagggaggggaacatcacacactggggcatgtcaggggatgtggggctaggggaggaacagcattaggagaaatacctaatgtagatgacaggttgatgaatgcagcaaaccaccatggcacatgtatacctatgtaacaaacctgcacgttctgctcatgtatcccagaaattaaagtataatttaaaaaaagtttaaaaaaagaaagttgccttagtcacataactagtaagagacatggttgggaatttgaacagaggccaatcagttccaaatccatgctcttgatcattaagctgaacttatggcaggaacttggaagacatggtaaaatggggaaaaacgtggagccagggagacttgtgaaagtgccagtgctcccactataccctgaaagaagtatctagacttacttttttctaagtcctctcctctaattctctcaatctctctctctctttctctaagagatgggaatgctgctctgtcactcaggctagagtgcagtggtgcgatcatagctcattgcactcaaggaatcctagggtctagtgccccttctccctcagcctcccatgtagctaagactacaggcacatgccccaaccctcgactaatttttttattttttatttttgtagagacaggatctcactatgttgctcaggctgtaattctgtcttgaagcttgtccaatcaggctttcagccacaccaattccctgagactgctctcaccaaggtcctacacttcactaacacaaacagcctattctccatcctcatcttacttcaccagggagctcctggttttcctcctacttcactggctatttcttctgtatcatgtgttgattctccctcatctccccaacctccaaacccttggagtactccagagatcaccgctttgctcttctgtgtctaacctcactaacttggtggtccaattcacactcttgactttgaataccatttaaatgcgaacgaattctaaattctgtacaaccagaaccattctcctgtagccaaatgcctactcaacatctccatccccaaacaaatttagttgttcaataagcctctcatattttacatatcccaaactgaacttctgaatttctcctccaatctgtagggctcttcccacagcctttccatctcagtggattataactccatccttccagttactcagaccaaaacttttggagttaactgagacacctctcttttttttcacaagtcatatccaatgtgtcaacaaattttggtagtggaaatattgcgggattttttaagaaatcagagagaccgatggggttcaggaggatatttattatttaggtgcactggccaagtcagattaacatccaaaggactgagccctgaacaaagagttaagttaccttttaagcattttgtggggtgggagagaggggtatctgtgcagggggaagcatactacagaagtgagaaataaagacagttattcaattaattgagacatgcattacatcatttcttacttttcaagaagaaacatgttttgcgacttgagtttatctgtctagtgaccttgcagctgcacagctagagaaacagggtcttcacaatgcctgggaaaggaggagaggtaagtctcactagccacagaaaaacaggcagttaatttttaaagggctccagctctttctctttctcagggggagttgggttttgttacatacaactgagtttccgcttacacattatttaatttcttttaattcctgttccaaaagaagccagatacaaaaggttacatgttgtctgattccatttatatgaaacatatagaagaggtaaatccatagagacagaaagtagattagaggttcccaggggctgaggaagaaatggggactaactgcttatagggtacagagttttcttctgataaaaatattttggaactagatagacattttgttaggccattcttgcattgttataaagaattacctgagacttggtaatttataaagaaaagatgtttaattggcttacacttctgcaagctttacaggaagcatggtgccgatatctgctcagcttctggtaaggcctcaggaagcttacaatcatggcagaaggtgaaaggggagcaggcatatcacatagcaaaagcaggagcaagagagggatgtggggaggtgacagtcacttttaaacagccagatcttgtgagaactcattcactatcatgaagacagtaccaagaggatggtactaaatcattcatgagaaaccccaccctcatgatcaaatcacctcccaccaggccccacctccaacactggggattacaatttgacatgagatttgagtgagaacacggatccaaaccatatcagagatggtggttatacaatgcgataaacgtcactggattgtacactttaagatggttgttttatgttgtgtgaacttcacctcaataaaaaaaaatatttaatgtacattcagccaaaagaagatttggaataggaaaggtcatggagatatattaacagccatttgatgggtggtaaggaaaagagtggttattagactgttttgtggccctcaaaaggtagaactagatcgagttggtgagcattataaaaccatcacaaaaccctggagagaggacccagtgctgaagaaccgtttgcctgccatgagacatgagggaagtaccagtgaatgccattgaaagcagcatccctgggtccaagggatggtcaaaggaccactacccaacccttccctagcctacgcctccattacagatgaccgcaagatttatttgctcattgctgccaaccaaggctgcactcactgcagttgctatcagtttatcatgggtaaaaggaatgtgcagtagagaactaactaactgcccacctacctccacaatcctatcaggacaaatcaccatggctcacatttccttacatttggcatgtaagcccctcttactgtctgtcatctatctcctacacagttcacctaaactgttctctcctgacccaaccttgattttcatcccaaatgcttccttgccatctctgggattcctgtcttcaccatcaccaaactcccctcaatcttccagtttcctgttcaaacttttctcctacctccttgctttgtcattagcccgactgcctccctaggacatcacttcccctgcagatctctcaagatgacaatatttattctccacacagcacatacttcagggttggaaggcaggggcaatcttctcctttataatgagtgcctcttatatatgtttattcatctgccctcttgtaaaacacacacacacacacacacaaagaagaaataaaataactctgcttctttgaagcttgtgacactgagataaaccatctcactgtcctcattgtagtgacctctcaactcctcatgcaagattggctttggcacctagttcctgatcttcctttccctgtaagcacttctcatagtcttacgggacttcaccatccatggcacaaccaataccacagcccagatcctcagctctccaatgacattttcctccactagacttgagctacctccttccctaggcacagcctcaacctcgacaacacctaagactgtaccgtctctaaagtcacatgttcaaacacttcactctttaaccactgtctcctattcttgcaagtgtattgctcaagtatctcattgcaatgctttttacttctacctcattgaacctccaggccattaaacatttccttatttctaaccatcaggtttctccttacttgtttgtttgtttatttgtttcttttttttttttttttttgagacagggtctcactctgttgcccaggctggagtgcagtggtatgatctcggctcactgcagcctccatctccctggttcaagtgattctcatgtctcagcctcccgagtagctgggactacaggtgcatgccactacgcctggctaagattttgtatttttattagagaaggggttttgccatgttggccaagctggtctcgaactcctaacctcaggtgatccacctgcctcagcctcccaaagtgctgagattataggcatgagccactatgccccacctggtttctccttatttatttcaagtctatgctgcactattaaaactgccttgacaaaaattataatagtgagaaaattatgacagtgaaagagatctgaaataatcaacccccatcttgcctttaccttccagactgcccttaataattcctgagcttgggccaagctatctttggcagaaatttagtttatagtttaaatgataatagcccttctccaaaactaaactgcctttgtaaaactaataaaagaccaccaatgaaaggttaggaggatgagaggagcctgaattctgctaaggtgtagatgtaaacaattaccaactgttattccggaggtcacaagatttgcaacatcgccaattactcctgcagataacagcactatcatagaatctgattggccttttgagatgtcttttcagattcttacatttcaactggtggctctacctggacccatcaacaagtcctgtggctccacccagaagcagacttaacatgcacaaggaccattttccacaccgctatgattgcatcccaaccaatcagcagcaaccattcctctgcctgccaaattatccttgaaaaatcttagccttagaattttgggggaggctgatttcagtaataacaaaaccccggtctcccatttggctggctctgcatgaattaaattctttctctattgcagttcccatcttgataaatcacctttatctgggcagcaaacaaaaggaacccattggacagttacactgttggcagatatatcttgcttccaaaattggatttttgtttaatgaatttattctgttttcttgatatttacaactgtgaatgttgtgtctgaattctctttatttcttgttgaaaagaactatattgctacagccagtacatacagatggatagctaattactcaacacggggggatgtgaccatcaccgcactgtgcaaatgaatgttacccattgtccacttttcccaaactacatagtgttatatggtatatgacccaatcaacggtggcaaagctccagaaataccacatagacatcagggacactttaaactaatcagcctatagtcctttttcagtaatttccaaacctggttgtgcatccaaatcacttggtaacattaaaaaaacaaaaaaatatacacgcaacattcgctcccaatcctactgaatcagaatattttgggttggttcaggaacattcaggagtttttcagggtccaaggtttatataatttgaggtctctctttgagaaaaggaacgtaaaagcgtcttgcttttatagatcttacaaagatgtattaccatgtaaacacattcctaggacccaggcccttgtaatttaaaggtttatctaagtaatgggccctgaagcttaattttcattatcttcagggcaaattacctgtgggttagggtttaggaatatatctctctgtgtatgtgtgtgcacattagcatgtacgcttgtgtggattttttttttttttttttttttttctgagacagagtctcgctctgtcgccaggctggagtgcagtggcgtgatctctgctcactgcaaactccgcctcccaggctcaagcgattcttctgcctcagcctcttgagtagctgggactataggcacgcaccactatgcccagctaatttttgtatttttagtagagttggggtttcgccatgttggccaggatggtcttgatctcttgacctcgtgatccacccgcctccacctcccaaagtgctgggattacaggcgtgagtcaccatgcccagcacttgtgtggatgttttaagctcccaggtgagtgaatacaaaactagatctttcccttctgtagcatctgtactgtttactctatgcatctcaatattttttcttttagtatctttcctttttctctcttattacttcctcttgtgctatttttacacctccttttttaaaaaattttttcccttttatttctattgacctttagccctcacaatgattcctacaagccccatttctgtaaatggggattgaaataattgctggacttttgagagatagatatattaaattgcaaactggcagtagtgggggcagttgatacataactaggttttaaagtctagccttctgagaccactcattccatttgtgaaaagtgattctacttcttattatgagccaaaatatgcattcattcacccatgcattgatttattcattcaataaatatttgttggatgtccactctgtatcaggaatgtgctaggttctgggaatacagcaatgaacaaggtaatttttccctacccctaaggaacttagagtttagtggggaagacagacattaaacaaacaattgtgcaagtaataatctataattatttattacaattaaaggaaggaagagacatatggattatgagggcattaaagaggagacctagtgtaagtagccagttctcgtgaagggacatgtattagttggagttctccagagaaacagaaccaatggtgtgtgtgtgtgtgtgtgcgtgtgtgcgtgtgtgtgttggggtgtgggggtgtggtattttttatagaaattgtctcacacaattatggaagctgagaagtcccatggcctgctgtctacgagctgagaaccaggaaagccagtggaatacttcaaagtccaaaggccctggaaccaagagtgccagtgttggaaggcaggagaagatgggtgtcccagcttaaaaagacagtgaattcactctttttgctctacatagggcctcaatgggttggatcatggccacccacattggtgaaggcaatcctcttagtctaccaattaaatactaatctctttggaaatactctcacagacacactgagaaataatgttttatcagggtgatagaaatcttctggagttaaacaatggtgatagctgtacaatcacatacatttttaaagggtgcgttttatggaaagtgagttttatctaaataaaatttctaagaaagagacttaacacagagataaacataagcacatttattgtcaacctttatagtgttatgtcaaataggtctgacataagcttaaataaatatatactttaaaaattataaaatattttaagttataatttaaaattctcaataaaactcaaacacaaaccacactggtatttcacacagctaatttctaatgcagtttacataaatatttacaacacttaaacaatttcaaagaaaataacactgtattccatacatagcctgatcacagtagttgttctctcttatttcccagagtttttctgcccctttaaaagaacctctgctgttctgatccttatcacatctctgttttgactgttggctttgttgttgccagtgttcagccagaacttctctgaaacttttttttcaacacatgctaagttaatggaagtgtaggagagttttgattctcacactcctcaaggctagagcagctttggcaattactgactgagaatttttcattgccagtgatcaactgaaaactggagattcctttggaattgttaaatctgcttataaataaacataaatgcttgctcacacaggcattcctctcttccagagcaccctaacatacagaagaaaacaaatagggaataactattagacatcttcattcgttaaaaatctaccagatgactcttttacatggtgagtttctattgtgaatttaaaatcttccataatatacaagaattatgtttacatatcatatctgacaaacatctttgtaggaatgcaaagcacatccatctttctgtattcttttccaacaaagacattcataaaattatacctttgtgtgtttgcatttatgcttttattagttcaaaacgtttggcctcatggaagtttttcatcgtggaaaccacatatttctgaaaaaatatctgacaatatacaaaccttccattcagtttttactctccaattctaccatgttttcaaaaaacaactgtagtaaaaacactcagaactttattctggttaacatcatgccttgctaggggacaatagtttccctttttgaaataaatttaaaacagatgtaacataatttgttaataaacaatgagggggtaatctagaataagtaacttttaccatatcatagttgacagcatttacaagttttttaagtccctaccacacttgtattgaatgaagaagtatggaagattataatatattcaatgcaagtaaaaatatcacaatccttaagaactctttaagaagcactgaatcccatagggatgaaagtgattaaattgtgcatagtaaccctcgcacagagcattcagtaggatttgcaccattaacaaccctccatgcatttgcctgtgggcattcaacatctgtcatttttttaagttataatatttttagtcatttttttcctctaaactctggataattattattcattcttatgacagcaactgtgtaatcagctgtcgaaacactgtgaagggcaaaagaaagaaagccacaaaatattgtgtttctgtgccaagattttacagcgagcaagggagagttagaaaaggaattctgagatttcagagtcttggtctcttcacctttgcttggaagaaaatatcctttcccttcattagccaacactttcttgatcctgagagtaggaaagggaacactgagtcttttcagttgaaggccgtccttgcctgctggactttgatctattgaagtggtgatgggtgttgcggtttcagccataaaggcatctggcatagtaggcaagaagggccagagacccgaggagagttatctgtctctgttaacttcagtgtatccctctagttccccagatgcacctgtttctgtaaatataaacatgcatgtcatcagaacacttaatattctgcatactgatcatgacaacaaaatgtaccttctaacacagacactctcactaggatagaccatgtaggaacatcgaattctattcagttaggacagtgatgatgtctacatattatacctctgtcaaaacctacagaatatacaacacagcacagagtgaattctaatgtagcctgtggacattaatgaataataatgtatcaatattggcccatcagttgtaacactaatataagatgttaataacagggggaattgaaggggtggtggggagatatgttggaactctttgtgctttctgctcaatttttctgtaaacttaaaaccgcacacacaaaaaaagttattttaattttttaaaaagtattcagagggacttgacctttccaaattctctcaaagcaggtcggagtagttaagaacacaaattttagaaccagactgccagagtttgaatcctggctacaccacttactagctttgagatttcagacaatttacttaacttctctgtctcattttcttcatctgtgtgataagaaataaagtaacaggccaggcccagtggctcacgcctgtaatcccagcactttgagaggccaaggcgggtggatcaggagttcaagatcagcctggccaacatgacgaaaaaatacaaaatctctactaaaaatacaaaaattagctgggtgtggtggcaggcacctgtaatcccagctactcaggaggctgaggcaggagaattgcttgaacgcaggaggtggaggttgcagtgagccaagatcatgccactgcactccagtctaggcaacagaatgagactccatctcaaaattaaaaaaaaaaaaagtaaaaagaaaagataagaaatatagtaccagcccctatctcagagttcctagcttagaaaaattcccagaatataataagtgcaatgtaagggtcagctatcttcattattattatctatcataaatgaaattacacaataaagctagatccgtttctttcctctccttctacaaaaaataaagcaactttccagaacaatacccaggtgatgatttctcccctgctccctccctaagatattggcaagtttggagggttcaaggagaaacagagcatgtagagaagatacctctctcataaccatttgtgatttacaagtcttacctgattcttttgaacttaaaggatgtaagaaggcttttggtagcttccatctgattcaaggctttggcagctgctgtggaatacatgagaacactaggtaaagcactgtcttccaacatgaagagagaaaaatatgtggaatgttcaatggcatgctttgtataagaatgcaacttacctggcaggaacaaatttctttgctgcaaaagaaaagacaaacaaccattaattcagactaaatgacttttaaggatatattaaatccagatacaatatgacttaattcatcaagtgttgcaaactcgatgcttcagggcctctgtaataatcagagcacaagcatggctctgtggcatctagggtaaaatgcaaagtgcacagccatccaaagggcatagcagcttcctaatgccagcaaatagctacggggtcatcttgcccaattcagctcccaatttttcatgagaagtccaaagtcttaatttaaatgtgagatttcctattttgtaaacgtcagaacttaactcaaaaatgttttaagtactcttaaacatgtaagccaaacaaaccatgagtgtagtcagatgtgcttccatattccttatgagagactctcaaatttaagcctgtactccaaataaatctccttaggaagaattttatccattttccttagagtgctcatcatggcagttccattgcacaattccgggaggcatcatataattcaacatgaatagcaccccctggagttgtacaatattaggcacgactaacatttttatttcctgaaacacttcccacactgagttgtactactaactcttttcttaatacttctgcttaattatactgcattttatccagattctaattattgtttaaatcagtaagcaagaccatgacttatcaatgagaaagaaatgtattttcaaaaacatttttgaagtacattcataaacttcctcacctttccgtaagcatttccgaagccagaggagaaatggtgctaatgtcaggagggagagtccagcagcagaaagtccagctaccaagggaatgttggactcagtgggagctaaggaagtaagagacgaagaaaggtcatgaggaagaattgatgttaaagtctctccgtcctgtccctttggccttttttctgtacattcattactaggagcagaagagctatctagtttaatacaagaagcagagatgtggcattacaggcctttgagatctgctccaagccacctttgaagctatttccaccattggcaggcagaactctaacttgccaagctcgttcacaataccacaccacaccttggttaataaacactgcacttgcttgctctcttgctctcactccctcttgttttccatttcccctttctcctctcctctctctgtctcctttttccagttgtcagaattctaccctttccatcaacatgcaacttctgttttttctctatccccatacaacttaatattcacaacttgtcaacctgggcgaactttctggtttggatataatgaatagttgattactgtaacaagatagctccccctttttctttttaatcaccagacaaccaccatcaatcaatgcatcaccttcacaggtaggtagcaggccagaccagtgtcctgtggctccacatgtccgagctgcagagccattgagcgtccatccttcaggacaggcgaacttgcacacagtgccaaacacgggctccccactgcagctcatgttgatctttcccggaactgccaggcttgaacattttaccactgcaaatgttaggtacacaggcagagtttcagaaaaatctactggaaaacttccaaaacttgcttaaaagtcaacaatgaatgtaaagtgtaagcgctacttagttttcagcatgtaggaaattaggaccaaacccctttggggcaatctaggttcagaaactttatgaagtatttgacctgtaccctaaaaaagtctgcactcaattctaccttggcaggaaggaacctcttctgtccattgtccctgagatgtgcactcaagttgagttgatccatgtaattcaaatccctcctcacagctgaaggcacaagaggacttgtaggtgaattctccaataggggaatgagcacacctcaccaaacccttcgggggctggtggacagcatcgcatctcacagctggaacacacgagagagcactttagaagtttgtttgcatctccagcaatacgtttcccaaggtaaccaagttcccaagctcttcaatagttctttttatcttaaaataaaataaaaacaaagactgtaccttcacatgtgggcttctcgttgtcccactcccctgtggggccacattggagccttttggatcccttcaacacaaaaccctgctcacaggagaactcacagctggacccataacggaaactgccagaagcactaggaagacaattcatgtagcctcgctcggggttggacaaggctgtgcactggaaagctgagacatcaaaatgatggtcagaaaatattgcagtggaactagagagtacttggcgtttgttgagtgaacccagttcattcaagcaacacttggagaactgaagattctttataattccctggacaaatgggaagatggctgtgttttctttgaatttcagccccctcactgatcatggcactaattaaaagactaattaatcagaacattagttcctgagcactgttcttctaacacacaaaataaattatggtccaaggaaagatttcacgcagtctgaggacaacatatgggtcatggatgtttatagatggtgccaaaaagaaagaaaagaaagcacccctataaaatttgtctgttttgcagtttggtttttgtgttatgttttgctactggaaatcattctgtgctggctttggctaggacaaggccagtgcctgatagtaaaaactgcttgttttcaatatccttgctctcactttaaagtgaattaaaatttactgcttatatatgcatcaatactatctctgtagctgacaccatgcttgaaacagtctcatcactgctaattatgagccatttcagaagacaggtgtgatgagagttttacattcaaatcatgttctcattattctgctttccgaattttctaatatgattcctttagattaagaattctgtctattccatgctaatgtctacaaagttttatcagcacatcacagttaaaaaaaaacagcaaagaattcattcttaacacatatgatcctttccctggccaaacattagttcttttaaatgaatctcaaagatacgagggttgctcatcaaatctgatttctatagttaaagtgggtattggttttttttttcactgtccaagtttgaagatggttgttctttaagaaagtataaatcgaaggatctcaagcttaccttcacaaactgggatttgctgtgtccactgcccttgagtggtgcattcaacctgggctggtccctgcaacatgaagccttcctcacaggtgaagttgcaggatgatttgaaggtgaactctccagcaggggaatggctgcacctcacagagccattctgaggctggcggacggccctgcatgtcacagctgtaacaaatatacgcattgatattagcacggcctagaattagcttgcccatttccagtatgggttgagagaaagaatgttcacagtaagtctccatgtggaacaactctacctttacacgttggcttctcgttgtcccaattcccagatgaggtacactgaaggctctgggctcccattagttcaaatccttcttcacagtcaaatgtacaggttgtgttccatgggaagcttccagggttttggaaacattccacgaacccattggctggatttgtcacagcatcacactcaaccactgaggattttaaagagcaccatgaattttacagaagaatgatcttttcacttcctattgagctgggtgcctaacagagtgaggaagctgccttcaaagggtagatcccaaagtcctatgtcaattcttagggacatgcacagccagaataaaagcttttattctttttcatggatattctatcttttctgatttccactttgcctatgctgagtggtctctaatctatgttatcatttacgtgaggtaaaaatttaaaaaaaatagattccagattaggagttatgactagtactgacatacgtaggctattcatttattttagcccatcagagcctgaagaactgatttttctttttttggcctctggttcagaaagataaaattaagagagaaaaagagatactaagactgcttgactatcatggtcttaagttagtcccatggcttggaaaagttaaacagggaaacaagatgagaaatccattgagatttctagagctttattgttttatggtctcccttacaaatcaccagagcctcagaaacacccatttcaagcatagaataaaaaaacctctctcaacccaagcaggtactgggttggcaatatacattggctgagagaacaaattgtattaaaaacaaaaacaaaaaaaaaactttccctgaagttttgaaaatgtaagttgaatcaaaaaacagaagcaatgagggatgagttacagaacgttctgtgcattctcagagggatttaccattgcaggctggaataggagcactccattctccagaggacatacactgcatggtctccatgctgcttggcaggtaacccctatcacagctgatagagcaggaagaattgtagctgaagtttcccagtgggtgactgcaaaccaggcttccatgctcaggggattccagggctgtacagttcacaactgaaaaagaaacccaaatcagttctgctcatctctcacctttaacagataagaacactggaaactagaactacagtttggttttttttttttttagtttaaaaatttataaaatttctaatggaatttgtaaaattgactgtaattctaccccttttcttttattcaagaaaatgctgatccataacaacaacaacaaaaaagcagtgatgacaaccataaaaaagaaatattgagtgatatggggagagtagtgtaattgtgtttacctcaaaactgttcaaattatatgaacaaacacagcaaacttaggtaccacaacaaatttcttgttacttttctcacaactgctaaaaatactacagtaagcttccaaccaggatgagaaccattcacaaagctatatttcaaatttaagtactagaatacattacaaattttaaaaccctaatgctgcactgtctactatagtagccactatctgtgtggctactcaaatttaaacttgaattcgttgaaatcaaataacatttaaaattcagttcctcagtgtcaccagccacatttcaagtactcaataaccacatgtggctcataggtacacactggaaaacacagctatggaacatttccattatcacaaaagctctactgcacaacgctgtgctaaggaatcttggagagaagctcatctaactctcttaatgtacaaatttaggaactgagacctcatttcattcaagtgacttgctccatgctacacggctagtcattacagagccagaggccagagcatgaaccaagataccctggactctgtaactcactcatttctactgcaacgtcttgttaccacctagatgaggtgagtacatgttcctcgcagggacacagaattacagtttattgaatgtgtcctgtgtgccaggcaccatgtaaccatgagcctatgaagttcacactattattatcctcattttacaatgagaaaactgacatagagagttaaactatcttgtcaaggtgccaaaataaataactggtgaatctaggactcaaacccagcagggtctgacttcatagtctcagctcacgatcaccatatgacaccatctgcaccagggaagggaaggcatgcagacctgactctaatgccagctaggacgtgagatggtgctaccatctcaagtgaagaaagaggcaagaaccagacttactttgctcacacttgagtccactgaagccagggtcacacttgcaagtgtaattattgatggtctctacacattcaccgtggccactgcaggatgtattggtacaggcagctacggaaaatacaaagcatgatgaggaggactattactgtgcttatactgagtgcctttgattttagaatcaacagtgtgcaacagagacatcagcagtcctacagagtgccatagactttaactgaagtgttttacaaagttccaaatctgagtttcaggcccacctatcctaaaccttgatgctaatgtatagctgtggctggcacctaccgtagaaaatttacttcttcacaaactctgaagacagttcccctaccacaaataaacaagtaattaaaatatgtattgtgtgtgtgcatttttatatgtaaagaactacatatttgcctacagtatttatatatattttatatatatacatacacacatatatgtgtgtatatgtgtgtatgtatatatataaaatgtatataaatgctgtaggctatatatatatacacacacacatatatgtgtgtgtgtatatatgtgtgtgtgtgtatatatatacatatccacatattcttgcccacattcacacaaaacagcaaaagagagaaactttagcagttaaacagaatcttttggaacataaaatgaccacaatagagagcagtttttgcatgctgtaaatttgccaagatgcccacacactgaaactacctcccactgctgccgcaaactccctacctgtgtagcatagggcaagcttcttcttgctgcacctctcatcattccacatgcccacatctttttctctcttgatgtagatctccacgcagtcctcatctttttgcctattgttgggttcacctggagcccagttcttggcttcttctgtcagaggtttctgggttcctacccagacccacacattgttgacttttctgattccaatccagtaataacttggtgaatagctcaatatggagtttaggtactcaatctcttctttgttttgaattgcaaccaggtgtgtgtacctttgctgacaataagcactggcctcatcataagtcatagcttccgtggaggtgttgtaagaccaggctccactctctttaatgagaagcactagtgggagaaaaagaaaagaaatggtagagtttggtactgttgtggtttaactctgacaactgtgctttttattgtcttatttttggcaatgtttgtgacatggcccagacttttctcatcttttcaaaagtaagaagtacgtatgaagaaacagcgacttattgtttatctcttttgtgactgccacccactaggtaccttatccacactcactcacaacattatagtatacccattttgtagtagaataataatcagaataactaagctttattgagcacttagtatgcaccaagaagcactgtatgaggtactttccatgaaccatgctattgaatcctcacaatgcatctgggaaataggtcattatgatccacactttacacttaaggaaagggagacaccaagaggtaaagtaaatgaccccaagcccagggaagaacacattgcaggtagaggtcaaggatgctgccagatatcctgtgcaggacagccccagacaagcaaggatatttcagtctgaaatatctatagtgcgagaatgagaaatcttggtctaatggcactgacttacccaaagtgagagctgagagaaactgtgaagcaatcatgacttcaagagttcttttcacccaaaggtttaggcttgaaatactttcctggggagataaaacacaaaatgaattaaagaaggaaatcgtgggtagctagttacattattctaccatgatgtttaaggcagcatcctaagattttgggcaaaggacactagtgcaataatctttatttcagagtttaatcaaataaataaacaaattttaagactttcattatttaggtcaaagagaaaagacaggttttagctacaatacaataagagcttgtacagatgtggtttttattagaaggccttttgcatatctgtgtttcatggcccgaggctgcccttataaagcgttctgcacttaccgttttgggaagcagttgttcaaacacaggatctctcaggtgggtatcactgctgcctctgtctcaggtcagtataggagttttgatgtgaagtcagccaagaacagctgaacactacttcggctgaggcccttttataggagggattgcttcctgtgaataataggaggatattgtccacatccagtaaagaggaaatccccaatggcatccaaaaactttcccgggaatatccacgatgcttaaaattacaatgatgtcagaaactctgtctcttgaagctacttcacctttgtccatgcctttatatcgtatatgcaattttattaatatgacaaaaatgcatgatttttaattataataacataaagtctatgtctttaaaaagttgtaaaactttgcttgttagtagtgtctctcatgtagttgtggtagtaattagaatttcagaaacagaaggaaaccaagaataggtttgtcatccatagtctactaccttcaatttctcattcatagctgtggataaccaatcactactcattttttcttcctttttcacctgccaattcaacatatttaacatgcactgtctcacagaggaatgactcacaaggtagatattaatcttcagattttgcacggcagttatgcctaaattaaaatattatctaaaaataatatctaacactcaaatggttaaaataatgccttattttaaaaaaagaaaaatgggaaatagatatttacatctgggaaagtttcatggtttgttcagtgaaaaaaataaaaaggaggccaggcacagtggctcacgcctgtaatcccaccactttgggaggccgaggcaggcggatcacctgaggccgggagttcaagaccagcctgaccaacatggagaaacgccatctctactaaaaatacaaaattagctgggcatggtggcgcatgcctgtaatcccagctactcgggaggctgaggcaggagaatcgcttgaacccgggaagtggaggttgcagtgagccaagatcacgccagtgcactccagcctgggaaacgagtgaaactctgtcttaaaaaaaaaaaaaaaaaaagaaaagaaaagaaaaaaaataaaacggaaaactatatatatatatttaattggtcaaaattttgtttaaaatttttgaaatgttaatgtgcaaagaataaaaattcttccacaatgttaacagtgactaactctggatggcaggatttgggataatttttatatccttcattattattttcaggattttaaagtttttttcaatttccctttttttcacctttatagtaacaagaatacagtttaaagaaacttgtctctaggccaggcatgatggctcatgcctgtaatcccagcactttgggaggctgaggtgggtggatcacctgaggtcaggagttccagaccagcgtggccaatatggtgaaaccctgtctctactaaaaatacaaaaattagccggggtgtagtggcgcatgcctgtaatcccagctactggggagcctgatgcaagagaatcgcttgaacccaggaggcagaggttgcagtgagctgaaatcacaccattgcactccagcctgggcgacagagcaagactccatctcaaaaaaaaagaaaaaaagaaaaagaaaagaaaagaaatttgtttccaaatgcaacagaaggagatgtatgtggtatcctatattcctgctcttcattttgacatttcttctgggtgattgtatacattccccatctctgcatcttaccctatctaaatgatggtaacagtaaatggggatcattttaatttccatattctgtaggttttcagagctcaagtcaagctaatattctatatctacagcctttcaaaataggaggtctatctaaaaatgtactgtcagcagacctgaacgagtagtggtaaaagcctcgtttttctctttacttgttagcactggtctttctgtgttcataaagatgtcaagacccaaaaaaaaaacaagaaaagagaagaaaaattccaaaaaagacaactgattagaaaaaaataacttaattaacgaatttaattcaacccctatcaaaaagcatagaatttattccctccaccttaccactctcttacatgatccagatactgacattattccaattctttatcccactttacttagctcaatgtggttgttgcttcaataaattcagaagagtaatcactcatatagtgtttatttagattttagggcagaatgtcaagttgggttaatacattatctgtatgtattttatttttaataaagtatgaatacataatctgctatttttaaaaagcatggtcaaatgtatagagtagccaaatcttaaaaaacaatttatcttcgatatcaataaagtacctaataattatattgctaatagaaattagtcgttaacatccctagataactaactttattattgcgaatttttcataactaagtttatagtttatctcttcccctttttaaaattagttcaaagatatctaaaaatagccccagtggtgatgaagtttctattttacttacatatatatgtcctggacccccaattataatctctaacatttattgagtgcttactatgtgccaggccatattctgagcattttgtatgttcacctattgattattcaatccgtacaacagcctatgaaataggtactcctattatccccattttacagatgaggaaattgagaatctggggattttatctcattcaaaagcacagagctaagggttgaaaccaggcagttgatatccagagcccactcccttacctgctactccaaaccatgatttcttttgttgttatgccccgagattccttgttctacccaagtttcctgtactcttcttgccctcttcttcctgagacatccttgaccatcacagctctccactgagataactgtgtcctgggttctgagacatgggggctggaagggaccccagggacagtgagcagtagggagaggatgcagtgagaacagaccctggatccccggtgcataggcagggagaaagtggacaaaggaaaaaacaagcaaggcaggtggagccatgcctaggtaaagttgatccctaagccacagttcccagaagttcctgattcaaaagcaaattttctctaaggtcaaagggcaaactgattattctaaattctaaactgattatttctaaattgagaaagcttcagggagagatcccaatattcgaaggataagagaaatgaggagtggaagagataggtgagtaacagtaacttaaatgtagactatatataatatataatatatgtagagtatatatatataattacaatatattatatatgtggaatatatatattatttatatatatttatatattttatatatatagatatttttatattttatatataaatatagatatttttatattttatatataaatatagatatttttatatatattatatataaatatatgtaaaatactgtgaaagaagaatagaatcttgagacctcaaattcactatgccaaagggaaagttaagcttgggaaatgagtcatgcaaaaactgccttccttttgttcccaaatacctgtaatttcacatgcttactttatcttatataaaatgtagatgtactgagcatgagatccatgcataatttccctctagtcccttctttttacatgtaaagtgtagactcactgagtgttacagagccttgccacaatgtaaacacttgtctcattgccaacccatctttcgtttattttcttcccctcctgcttgctctttcccctctaaagatggaagttcccaaaactctctttggaaaaagcgcaggtcacagatcctacagtgatttgtgtttcttttacctgggacaaaataaacctctaatctgttgagatatgcttcagttactttttggtttacaatatgtacatgtatgtatataatttatatgtatataatatatgtacttgttttaaccagaggtatgttattcaaaatccattcatccttacaattacctgcattctcccacagtattttctgtgtccctgcccccgaggttgtcactgcaaatcaggtacatggatactgggagctgatgggctcccctctggctacctgggctgctgaaggggccatagacagacccagctttcctctcgtggagaggccctgggccagcgctgcgtgggagtgggattacaaccagactatagcttcttcacctgctttttcctatcaggatttcataagaggcaattgcttgttttttgagggtgggggcaaatcagggggagttgaagaggaaattgggtaagatttgaatagttgggcatgttgaatattatgaatatcatctccctcttcaaataatccaaaatatacccccaagaaacaggctgattagaggtgcttcaaggctccactgaatctcccaagctctgaagatgtagctagctgttaccggattgccggttttcaagcctcgcctcacatggaccctcttggcagtttctcgcatgggggaagcatccgctacatagatgggaatgaaaagaggaaagaagacggtgcaaactcaggcacaccccggtgtctgccaccagtgctatttaatctctgaggtgtcacccttcctggctttattgtctcttcctggaagtctcttgtcctctcctccacaccctttaatcaggcatcaaagactttaaccagttttgctgtgtgcccaggcccactcattctcacttttatggcaaagggagtgggagacagagagatagccagaaagaagagattggggaccccaagacaaatgttagaattttaaccaaggccaccctgtggacaggagattattgggtttagtggaaagcagcactggccacaaccacacgtggcaaaagcatctatcgaggagtgaagttatatttggtgaatgtgaccgggaagcaggggcagtggtgtcctcctgccttcctgaggcactctgttcccttacctctgcgaaggcttattttacccctgagtgcttagttttgaaagccttagttccctctctcccataaaaaagctctactctgctaacatctaagttacctttgcagagtcttaggtagagggaggaaatcccaataaagattccaccctatctgcaaaatacaaacatggtatttcttgcattcccaaaattgtgaaagaaaatgtgtatcaccacagtagagaatggcattttttgtttgatcaaaacctaaatatatttgatgaaaatgtgtctggttctaagtttatttcccagaaagccatgtttactcacttggaatttatagacatcttataatatctgagtcgagtaggagctccgggctctacctcactcttttctcccacacccagggggaagtgtagggttctcagactttagaataaagaggaatcacctggacaactcacctaaaatgcacatcttcaggtctcatactcagaggctctgactcaacaggtctgggtggcgcccaagaatttgggctttaaatgagtatctcagatgattctaatacagaatgtgtaagatgaccagatcctatcacacttagatgtattggcctagggccacctaacttggagaaaatgttagtaagaccccgtggttggtgctcagctataggtaccagaattttgatcaaaatttactatcattgtgacacttctcttcggaactggaaggccagaaccccacttgtaaagtgctgggaaaatacaaggaaaatttagggtgagtagcattttgaattcttacacatggaaagtaaatgtataagaattcttaccaataaaaaaaaagcaagagagaatagctgctaaagaattaacacaaatatgtatatattagttattctcttttctcctctgattccagaggactttgtaattccactaattcttcttgagcttccaggatgatctgagacttgaatttttcatgtgctttttgcttcctatttggcagcatcttatcttgaagtttccgctttctgcttggggacctaaaaactaactaatgggaatttcttcaaaatgagcaaactctggtgaattcccaaagcggaagaaacaagtgaggatcgggctggttaattaagagaacttttcctgaatgtagccagactgtttgccgactgttgttaacatgagggaagaaatacccctggattttagaagagccccttgtttgttttccttggccatttgtgctgcttgttttgtaagtcagaaatttcctgaaggactattattagctttgttctcacgtcagaaaacttctgctctggccacttttaaacatataacttggattttactgtattagaaaatgtaacaattacagacagcactaaaaggacaccaaagggcaaagaaaatgggtaacttttttttcttccccaaatctaaaataggtgattttggagaagtaggagaaaaacctggattttctagatctctttagagctcaacaactgatatagttaattatgtaagtctttgatatttggaaatgattggattaaccggataacaatgaatatttaaatacagtgatttggccaggagcagtggctcatgcctgtaatcccagcatttggggaggctgaggcgggtggatcacctaaggccgggagttccagaccagcctggccaacatggtgaaaccccatctctactaaaaatacaaaattagccaggcgtggtggtgcaagactgtaatcccagcaactcgggaggctgaggcaggagaattgcttgaacccgggaggcagaggttgcagtgagccaagatcacgccattgcactccagcctgggcaacaagagcgaaattccatctcaataaataaataaataaatacagtgatttaacacaagagatttctatttcacactaatgagctctgtcactggggcaagcttctttgcctcattaagtctcagatttcccgagagcttatttatttataccaagagtgctttactaccgtctctgctagctgtgacataatatgacaaaaggtataaatatgggaaaaggcactaatttatatcaaagcgttcttcgtttttccttgctgtgaagtttttagctaataattcataagaatataccatatttagagtgtttactatgcatgggcctggcacttcacatacattgcttcttacaaattttacaaagtgaaaggtagatattaatctcattttatggaggacaagatagagatctggagaggttacataacttgccagtgttttttcagttaataaatggtagggtggagattcaatctgtgttactctaaagtccgtgtcctttttattggctccatgcctactcagatttaaatctcagcagggaagtaaaccttagtttttacatgagaaaatgttacagcagccttctcggcttcctttacccccatcccagtttcacgagcttagtgccttagatcgggttcctttagaagcagacctcgaaataaggatgtgggtgccagtcatttattgaaaagatgatcccaagaaagcctagtaggagagtgaggaagtgagatggggaaaggaagaaactccacaagaagtgtgttaataagcaggttaccgctgtgggcagccatggggctcagctgcactaacaaactctgtctagtacagaaaacctcagggtctccccaaggaggggcaagaagtctgcctagggtatatatccgccaactcagtcactggctgagagctgatcctgggagggcatggttaattcctctgcactttcaagtggattcctgtggtcagaaaaagccctctacaatgaattccagatgcttgtatttaaatctgacatgatctgaatgctgtgttgggacagggtgggcgttattagttttctgtcattactgtaacagattactacaaacctgatggctgcaaacaacacatatttattatgtcatagtttgtgtgggtcagaagtacaggttagctcaactagtttctctgctctaggtttcacattgccaatatcaaggtgtcatccagttgggctcttcttgggaggcttggggatgaatccactttcaagctcattcagattgttggcagaatccagttccttgtggttgcaggaccaaggtccctgttgccttgctggctgttggccaggagtcattcttagcttctagagactacctgtactctctgactcgtgtctccacttcacctttcaaaccagcagcggctagtcgagtccctctcttcaaatgtctccaactgtgccttcacctcatttctcctctgtgtaccatgtctgcctctactgcttgtaagggctcatgggattacattggatttattcaatccaggataatctccatattttaaggctagctgactagtgatcttaattccatctacaaagtcccttccaatagtactgtattagtccattttcatgctactgataaagacatacccaagactgggcaattcacaaaagaaagaggtttaattagatttacagttccacatggctggggaagcctcacaatcatggcagaagtcaaggaagagcaagtcatgtcttacatagatggcagcaggcaaagagagagagcttgtgcagggaactcctctttttaaaaccatcagatctcataatacttattcactatcacaagaacagcatgggaaagtcttgcccccatgattcaattactcccaccaggtccctcccacaacatgcaggaattcaagatgagatttgtgtggggacacagccaaaccatatcaagtacctagattcatgtttgattaaacaaccagggagcagaaatcttcaggagtggggggcatctttagaattctgcccaccaaggctgggcgcggtggctcacacctgtaatcccagcactttgggaggccaaggtgggtggatcatgaggtcaagagatcgagaccaccctggccatggtgaaaccccatttctactaaaaatacaaaaattagccaggtatggtggtgggcacctgtagtcccagctactcaggaggctgaggtaggagaatcacttgaacccaggaagcggaggttgcagtgagccaagattgcgccgctgcactccagcctgggagacagagcaagactgtctcaaaaaaaaagaattctgcccatcatagtaggctgtcctacagagacataacccaggaattaggtgaatggctaacctaaattagcactgtgatgtgttttctgacttggtccttatagctcctctgcttagatgtggaactaatccatgaatgcaagggtttgtctagagttttaagtgggagttaaatatccaaagtacaggagatattatgggtgcctcatccatgtccccttggcatttatctttcttggataacccaactctattagtttttatatctcacttgttcctatactctgtgaactgatgtcccataaatagacatttcattttgccagtcttcttgaacaataattacgattattaatctagcagttatcattaattggccacttcacattagacacagcacttaggacttaagaataccatgtcatttgatcatcataatatggtcaggaattaagtattgctatccaaattttacaaagaaggcactgagggttagagtttaaataacttgcttaagatgtcatagcctgtaagtgacaaaactaggactcaaatacaggtccatctgactccaaagtctatgttcttggctaccacactgcctctcctacaagtgacctgtggttttactactatattcacactctactaactttaccatctcccatgagtctgtctagaggagggcacacacagcacagaaaacacatgaatgcaaaataaggaagggcctacttactacacagagccattctaatacctgatgtttgctctaatccagttttactattaattagttgctggtgcccaagtttttactgagaaatggggataattttggaagtcataatgatgccttcttctcatagggtattttatttgttgttgtatctccaggccccaacacagcctggcttttagtaaatgatcaaaaatacctgttgaatgaataaatggagtcacctgaaacatgttaaacatttgttcatgtgtcctaatcgtggatttcaggatagtaagcatcctaaaaggaaagcatgcacactgttcttgctacattaatttctcacaatataaaaaaagaaaagcatctgaaaaaagctgccagccgctgtgtctcctaatatcaaactgagcacagatatggagaagctaagggagagggatgatgggccatgcctctaacctcatcatggcaaaagtcctgggggtcagacccgaggagagcaggaagtgtcttttgagggatacatttccacagtggaaataatgagacttaaataaatattatatacacagttcaactgtttttatgtgtaaaggtagtaggttttcacagtaaggaagcacttctttttttttttgtttgagacagagtctcgctctgtctcccagcctggagtacagtggtgctatctcggctcactgcaatctctgcctcctggattcaagtgattctcctgcctcagcctcccgagtagctgggacaacaggtgtgtgccattacacctggctaatttttgtatttttagcagagatgcggtttcaccatgttggccaggctgatctcgaactcctgacctcaggtgttctgcccgcctctgcctcccaatgtgctgggattacaggcatgagccactgcactcaccaagcacttctactgatagcatttacaaacccttcttagaatatttaaaaattctaagagaagagtaaattgagccttcccaactaatactaggaggttataaccttcataccaaaactggacaatgcttgcacaaaagaaggaagccaatgaggccacctagaaggaagactgggcattgggcccagtgagtcctggaaacctcatctgtgccagccaccccggcatggcctgtatgagtggatgagggtgacttgtccacagacaatagccatctagctgtgataaaggagtcaaggtagtcagctgcatctctttcacctgtttgccaatgttacacaggttgaaaagctaaggtttatgtaaagcaagcatcaaagatgatgaaatgatcaacctgacaatgagtactatgctgcattgtccagaaaggaactgtggaagattttgggctgaatttcaaaacagaatttcctcactctctggatgttggcttacttggcctttgatgttcagaggtggtgcctttgtgttgttgaacaatgttgattttggagagaaaacagagttgaaaaacccacaagtcattccctggggagtattaccggaatacagaggataatttcagcaagccagcaaggcctcatctctgcttctaatagataggaagaaaggaagagaggaacaatacttttttaagaagctcagctttatcgccttatctcatagaaagatgcctccagtctgtctggctaaaggtaattggcatgggaaagtctttatctgtgattctaacaagtggaatgtttcccttcattaagagagccttgtctggcttggggaaatgaaacactttctccgatatgagtgggctgtaacccctgctactaaatactcagaagaaataaggcggttgtggagcagtcaggaatgagtcacttgcctccctggaatattcagaaaactgaatcaaaagtacattcttctgggttttcttagtctaatagactaagggtctctactttgttaaatttctgggaaacagcatagaatgggagaaaaaactggtcactgtagtcatgcaaatctgcaaaacaaacaaaaaagtctgggtattgctgctaactagctatgtgaccttaagcaaggtattaactctctctgaatttcaggttcttcatctgttaaatagcatatctgtaaaatgggaattattttcatatcataatgctgtagctttaaaaaataaaataaaatggatgagataatcagaattaaagagcctgggatatatagttaatatatagcagcatgtaaagatcctgttagaaatgctaattttacagttaaccatttggagatgatccgccaaagctgctagtgtagaggcaactgagaatttgcctgtccttcagaatatgaataaataactgtcaatgatgtctcaagcctagaaaaacctatccatctggatgggtgggaaatttctaggctagtattgagaagcccatttcttgggaaataggtcctggactgagtgaaggaaaagaaacagtaaaacccatggtaaagcagcaaggctctctagaggctctggagaggatgaattgaattctagaagatgaagtagggaagacgctttaccttcttgtgaaatggattcaaagattcaaagaccttcgggaatctccaattgtataaatggcaccatagctgtatgttccatggaacactacttcccagagatgcccagtgaaaaaagaatgccacagtcaaataagtttggaaacactccattatgtggccacctccttgaagactctaatgcacattagcatgttaaacagtcttgagaagtcctgcagagcagaaattgcttcacatctgctaagccggcagtttcccaatatacttgattatggatagttttttccttacaacaccattctctgatatgcttccaatgacatgaaataaatatatatgcatgaggttcttcattagggcatactttttaatagaaaatattgagaataatctaaatataaatgcacagcatttaccttttctgcataaactatatacaggcataccttggagatactatgggtttggttcccacaatatctccaaaaccacattcggttttatgaccactgccataaaaccagccacatgaattttttggtttcccaatgtatatcaaagttacatttttactataccatagtctattatatatacaatagcattatatctaaaaaacaacgtaaacaccttaatttaaggctgtggctggtttgattttctacccagaccactaaaactttcttcatatcagcaataaggctgtttcactttcttactattttttgtgatagcacttttcctttccttcaagaatttttcctttctattcacaatttgtttgatacaagaggactagattttagcttatctcagtttaaggtgtttacattgttagctaaaaatgctaatgatcatctgagacttcagcaagtcataatcttttgctggtggaaggtcttgcctcagtgttgatgtctgctgactgggtggctttggcaatttcttaaagtaagacaacaatcaagtttgacatatcaattgacccttcctgtcataaatgattttttttttctctgtagcctgcaatgctctttgatagcattttacccacagtagaattttcaaaattggagtcaatcctttcaaactctggtgctgttttatcaactaagtttatggagtattagaaatcccttgttgtcatttcaacaatgttcacaccatcttccccaggagtatattctacctcaagaaaccactttctttgctcatctataagaagcagctcctcatccactaaagttttatcctgagattgcaacaattcagttacatcttcaggctctacttctaattctagttctcttgctgtttctatctcatttgtgcttactttctccgctgaagtcttgaaccccttaaagtcactcatgagggttggaatcaacttcttacaaactcctgttgatgttgatattttgacctgctcccatgattcatgggtattcttaatggcatctagaatggtgaacgttttcagaaggttttcagttggctttgcccggatccatcagacgaatccctatctatggaagctatagatttataaaatgtatttctttttttgtgggggcatagcgtctcaccctgtcacccaacctggaatgcagtggcacagtcataactcactgaagactcaaactcctgggctcaagtgattcttccaccttggcctcccaaaacactggattacaagcttgagccactgtgtctagcccaaaatgtatatcataactaatgaggcttgaaagtcaaagtgactccttgatccatgggctacagaatggacgctgggttaccagacatgaaaacaatactcatctcctcatacatctccttcagagctcctgggtgagcaggcccattgtcaaatgagcagtagtatcttgaaagaaattttttttctgagcagtagatctccacagtggacttaaaatagtcagtaaactatgctgtaaacagaagtgctgtcatccaagctctgtttttccactgatagggcaaaagcagagtagatttggcataattctctagggccttaggatttttggaatggcaaattgagcattggcttcaacttttttttttttttttttttttgagacagagtcttggtctgtcacccaggctggagtgcagtggtgcaatctcggcccactgcaagctctgcctcctaggttcacaccattctcctgcctctgcctcctgagtagctgggactacaggcacccgccaccatgcccggctaattttttgtattttagtacagacggggtttcgccatgttagccaggatggtctcgatctcctgacctcgtgatccacccgcctcggcctcccaaagtgctgggattacaggcgtgagccacagcgcccagcctgtcttcaacttaaagtcgccagctgtgttagcctctaataagagagtctgcctgtcctttcaagctttgaagccaggcatcattctcttctctagctatgaaaatcttagatagcatcttctcccaataggaagccattttttatgccctaaaaatctgtcgtttggtgtagccaccttcatcattgatcttacctagatccgctggataacttaccacagtgtctacatcattacttctgcttcaccttgcacttttatgttatggggatggctcctttcctctaacctcataaactaacctccactagcctcacattcttcttttacagcttcctcgcctctctcagagttcacagaattgaagaatgttgggccttggattacactttggtttaagggaatgctgtggctggtttgattttctatccagaacactaaaactttcttcatatcagcaataagactgtttcactttcttactattttttgtgatagcacttttcctttccttcaagaatttttcctttctattcacaatttgaccgtttgatatgagaggcctagattttagccaatctcagtttacaccatgcctttttcactaagcttcatcattttagctttttatttaaagtaagatgtgtgacccttcctttcatttgaacacttacatgatgatgcctggcttcaaagcttgaaaggacaggcagactctcttattaggggctaacacagctggcgacttttaagttgaagccaatgctcaatttgccattagaagccattgtagggttaattaatttgcctaattttaatattatggtgtctcagggaataaggaggcctgagtagagggagggagatggggaaacagccagtcatcagagcacacacaacatttatcaattaagtttatcaccttgagggcacaggtcatgatacttcaaaacaattacaataataaaataaaaaatcattgatcgcagatcaccataacagatataatgataatgaaaaatttgaagtattgtgagaattaccaaaacgtgacacacagacacaaagtgagcacatgtcattggaaaagtggtgctgatagacttacttcatgcagggttgccacaaatactcaatctgtaaaaaattcaattatctacatagtaccataaaaacaaggtatacctgtttatataatcaagaccaacagaaccctagagaaaatagctcactccctagctcggagacattctaaccaacatacacttacctttctttttgctgtgtacagaattcaaatccctgtctcagcaaaattgcaaagtatcaaatgtcatgtccatctaatactcaaaactgcaaatgttaagtcttgtaagcccagagaccactgtatatacaagtgttgctataagcattagttcttctccaaagaaaatagtccacttggtagaaacaaacaaaaagaaaaaaaaagaaagaaaaaacattttttacaagaagattcagtctcttacctacataagcaaaaatatgagatgttctcttatcatttttccatctatcttataatctttggtgctgacttagacactcattttcctttttgtacgtgaccatgtaaaagttcaagtcaagaaaaacttgttttgacatttgttttgctgagtgatgggtccctaaaagaaatttggctttgcttttgaaaagttcagcatgatattgtgtgaatttttcatggctaatgatttttagaacagttgtgatgtgtttaggtgttttaagaatatgaagcattcagtggtttaagttggttgttataaaatgaaagaatatgaaggaaagccttcttgtcttagaacacactgattcacaaataagcagcttctctcaaaatgttgtaattacaaaaattccaaggcaaatataataaactccttgtcggtgctatgtctagaaacttaacagccccaaagaaagtcctgacaaggcaaaaaatatatatatatatacaaattgtggaagcagggtgttgaaagaagaataaagactatataaggacaaactgtttaaaagggagggtatccttgaaagcttgacacttgactcttttgacgaggctgagggaaaacactcagtttcatagattgctggtacggatgtaaaatagtgacatccctatagagaggaatttggcaatatctagcaaaagtgcttatgcatttattctttgacctagtaatcccgcttctaggattagtggtgaagatacacctcaacaataaaaatatatatacattaggttattagttatggtttaatttttaatagcaaaatatttaaaacaacctacatgaacaaataggagacttactgaataaactatggtatatctgtacaataaagtgcaattcacttatgttgttaatttgttccaaaaatccagagccaaagagtatttgttatgctctctttagtataagaaaggggaaataagatatgtgtgcatctgtttatttttgtgaaaataagtacagaaaggataagtaagaaactagtaaaactagttatctcctagtgttagtagaaatagaatgaaagtgaattaggcttctttgagtatatgtttatatatagttttgacttttgaattatgtttatgtttacatagtcaaaaatataaattaatcaacagaaataacaaaaaaagaagaaatcacaagctttaaaatttaatacaaacagaaataattgaatctaacagtatatcaaagtgataacgtaaactcagaagaaaaaaacataatccaacataccagtggaacacaatattctaactgtatacattcagtggttatagtctaaggacaagaaaaattgcaaaaatatcttgaactttagcttgtaggatttttattggtagcaatactaatgtactaattctgaaattaatgttcgtgtattatagaattgagtaaatgaataaatatgttgatgttattgggaactaaaattatcattctgggagtagagaaatataaatatggacttggcaaatgaaacaaagacctgcagagagataaccatataaactcattattttaaaaattataagtgtcctagctctgttactgaaaaggcctagattcaatcttatcttgatagacaggagggcacccctttctcagaacatggtttccaaatgccattctccattaaaaggaacaaggtcttcttggagaaaagactgattctaggtctggattaggtaaagtacaacgttagtctggaatttcttgctgaatcagaagtaagaaagtgctcaaaaacatgggaacatgtcacaaacacacgtgaggcaacttgaatcctcactggccatatttaggacaatcgagcatcaaaaaaaaaaaaaatgttgagaataatggattctaacacttaaaacaaaaaataatccatagcccacagaaggggaagagagggggagctcttatttacagatgaatatcaaatagcaaagacagaagaaatgacagaattagagaaacatcattttgcaaaacaccactgtaataatcaattcaggcaagtattattaatggatgtattactattgcgtaaaaccagttggggaacaggatattcatacagtctgaaggtgtcaccctaaacataacttattacaagtggaaaatggtgcctttacaatgaagaaatctagcagaaaccatcttaatctagtgatcaaacttagtatcaccaataatggatcatactgagtcatgtgtctcctaatatgatgcaccaggaaggatgcaacgtcatgaacgttgtattcttttgtattcaacagaccacccagggtaaaggcagctttctcacttactaatcagaattgttggttttaattcattttggattttaagatttcttactttcttgtcagctcagaaatttatttaagatgatttttatcttttattcaatactttagcttggagaaccattcagagtttctaactcattgtattgccaaaaatagaaaacagcatggtttcttttgaaaatgtctaactttaaagttacttgtgtgtgtcactcagattcacatagcttttttgcctagtaatgtagtatcatgtggcaaggctataaaaatgtttacaatcttttatttaatatgactcttgagagtttattctaaggaaataattgaatagtaacaaaacactattaacacaaagcatagcaatttgatttgggcaaccaaacactggaaacaacctaaatgtccattacaggaatcatttatgaagcaaacactaaaatatttattgtgaagattatgagaacatagaagacagttatgagagtaaatttgaaaacctgaacacaaaacttacatatactccaattgtaacttataaaaaatacgtgcatataaggataaaacagtacaaacaaaaaaatagttgcgttagattggtagaattatggctccttttgctgtcttaattttttccttttacattttgatacattattttaattttaattttaaaattcaaaagaatttgccactcatctttgccacttcaaggaaaaaagaaatgtgttcgattattctgttcttagtatagttttggcaatttcctcacgtgtaaaaagagaatactattaataatttcagtatctataagacaatataaaattaaagaatctagcccagtaactggtacatggaacgtaattaataaatcattatggactttttttctcacacccaagtagggaggaatcagtggtcccctagaggcccagtgtagaggtggcagcaccaatccctaggggagaagatcttggtgatgataattcctgagcagacagttagctgagaattcaagagcagaaaagtaagaaagaaacaacttcttgctaacacctttccacccacgtttccctgttctgttgtactctgcttaccctttcatggatggaggcagaggaaagagaaccaagtttgctcttagtcattcactatgttgtttaatctgccttccatctttcttatcagttcaaattagaatgtagacctgaatttaaatccccgttctgtcagttataatgtgaccctagacaaaacacattctctgaacctcagagaacattcttcatttgtagaatgggaagattaatctatattccacttggatggcaagtcttttataaactttataacctaaacatgtgtgagttgctagtatcattatgttggtaaagttattctgagatatgataacagaactgttttgtctaactccactagcatggttcaggtttagagagtgtggaattaaaaggctttatcctcaaatatgacttaaatccgatttttctcatccactttcctccacaaacaaatcctcaggaaatgacaaactttacatggttaaacatcagttttgtttagtctttgacatccacatggttaaatcatacatttgaaaactgcttatatttgtgttgtctatgtctaaattgaaaagacttattgaggaatagaagactacacatttttcagcaaacactgcacgttttgcagaatttccccaggcaccagtctccaggaatttattggctactaacaatactaagatatggatgaatgaggaaatcaaaatggagatcttgcaagttttgtgagaatgggtgaatggtccaaatgaagagataagttgtgaaatattagtacaagtaaaaattatttacaatgaaagacattttgtcaatagctatgagaattttaccattgacccagaaattccatttctttcttcagaaatacccacgtaggtatacatataaaaagttattcattacagtatcgtttttcataggaaaaagttttaaaaatcagaagctatctaaactatggtatatctaggtcatagaaatcaaatgactaaaaatgttaatataagcatatgtttttaaattaacttggcttgggtcttcagcaaaattggcttcttaacattgcactccagagttagacttacccactcagtcacttatcatgcaggagcagactcctaataccacatatcatagagcagagtaggacacaggttctctgcaggcaggcaaatcccaaagagaagggaggaaagggctgagacactgcatggtcaatttcttctgaactctgcaatgtacggaggtggacagtgtccacaaagattgctcccctggacccaccatcataataacacaacggctttgttttgtttttgtttttgttttttgacacggagttttgctcttgttgtccaggctggagtgcaatggtgtgatctcgactcaccacaacctccacttcctgggttcaagtgattctcctgcctcagcctcctgagtggatgggattacaggcatgcaccaccatgcccagctaattttgtatttttagtagagacgaggtttctccacgttggccaggctggtctcaaactcttaacctcaggtgatccacccgtcttggcctcccaaagtgctgcgattacaggtgtgagccaccgcgcccagcccacaatggccttttgtttacatctctagtgcagcactcatttcatgttctttcaagaagaatacatatttcatctttttattttatacagcaattagcacagtgcctggcataaggaaaatgatcattaaaagctgggtgaaaaacctaataaagctactgaggataggaactgcagaccagcatggaaagaaaactatgagccagatattgacatcatcctgaaaggcagaagatttagtataggcaagaagtatgcttttggaatatagaaaatctggattatgataagaaaagaatcatatttgtcttatcttacctactcacttctcagttccacatgtttctgaggctgtttgtccttactttcttttctgttttatccactctttctgttctttagattggatcattcctattgagctgacatcaagttaactgaccttttattttgtccaaactgctgttaaatgcatccagtgaatttttaactttatatagtatatcttttagtcctagaatttccacatgagttttttaagtttccatttctctgctgagatctcctatttgttcattcattatgaccatatttttctctacattattgagcataattataacagctcttctaaaattcttgtctgcacattctaacacctgaattattctggggtcagtctctgttacattgccttattacaaaaacagtataagtcacattgccttgtttcttaatatgcaaaatgatttttgattgcagactagacattttgaattaaacattatagagattctggattctcgagagagtattgacttgttttttccatcaggcaggtaacttgactggactcaaactccaaactctaggtcctctgtaatgggcaactgcagtaatctttgtttagttctttaagacttattggccaggcacgggggctcatgcctgcaatcccagcactgtgggaggccaaggtgggaggatcacctgaggtcaggagttcgagaccagcctggcccacatggtgaaaccctgcctctactaaaaatacaaaaattagccgggtgtggtggtgggcgcctgtagtcccagctactcagaaggctaaggcagaagaatcacttgaacctggaaggcagaggttgcagtgagccgagattgtgccactatactccagcctgggtgacaaaagcgagactccctctcaaaaaaaaatttattggcactgcttggcatctgctatgaatacatgaagttcatgggtcagctatagatctgggcacgttatacacagaatttgggtctccctttctctggatttctccttttctggatttcttttctcattttccagcagctgtggttgccctaaactcggtcctctgtttctttacggcagtaagatttgggaacttttaggttttacctgcctctcagacaaaataaaaaataattttcatcttgatgctactcctttcttccagatgtagacacctctctaatttccagttgctttttattgctctccagagtctaaagattatcattgttttctgtgggagagttggtctgataaaaactactcccccaaaactggaagctggaagcttgtaattatgaatagactttgagtagtattcttctttggaaaaggattttaactactccctatgtacttctttatttcctgtttttctcatccgtaatctttttattttcatacttcctaagtcagacaattttcctacttgaagattcagtgactgctatcaaatgacccccatattactaaatacaatatccccaactgcatttataaaaagaaaatttactgtttattagtaaacaatgttgtagaatagtaaaatattgctgggctttggagccagataatcaaggttagaatcccagattctaacttactagctggtgtattagtcctttctcatgctgctaataaagacataccccagactgggagactgggtaatttatgaagaaaagaggtttaattgactcacagttcagcatggctggggaggccttaggaaacttacagtcatggtggcagcaaggagaagttccaagcaaagagggaaaagccccttataaaaccatctgatcttatgagaactcactcactatcacgagaacagcatgagggtaactgccctcacgtttaattaccttccaccagttcccccccatgacacatggggattatgaaagctataattcaagatgagatttgggtggagaaatagccaaaccatataattccacccctggcccctctcaaatctcatgtcctcacatttcaaaactcaatcatgccctcccaactgtcccccaaggtcttaactcattccagcattaagtcaaaaatccaagttcaaagtctcatctgagacaaggcaagtcccttctgcctatgagcctataaaatcaaaagcatgttagttacttcctagatacagtgggggtacaggcgttgggtaaatacactgattccaaatgggagaaattgccaaaacaaaagagttacagaccccatgcaagtccaaaacccaatagggcagtcattaacattaaagttccaaaatgatctcctttgacttcatgtctcacatccaggtcacactgatgcaagaggtgggcttccaatggccttgggcagctctgcccctgtggctttgcagggtatagcctgcttcctgtttgctttttcacaggctgacattgagtgtctgtggcttttccatgagtatggtgcaagctgttggtggatttaccattctggggtctgggccaggtgcagtggctcatgcctgtaatcccagcactttgggaggctgaggtgggggatcacaaggtcaggagatcgagaccatcctggctaacacggtaaaacccagtctctgcttaaaaaatacaaaaaattagccaggcgtggtggtgggtgcctgtagtcccagatacttgggaggctgaggcaggagaatggcgtgaacccaggaggtggagcttgcagcgagctgagattgtgccactgcactccagcctgggcgacagagcaagactccatcaaaaaaaaaaacaaaaaaaccattctggggtctggagaatggtagcccttacagcaccaccaggcagtgccccagtggggactctgtgtgggggctctgaccccacatttcccttctgcacggccctagtagaggttctccatgagggttctacccctgcagcaaacttctgcctggacatccaggcatttccatacatcctcggaaatctaagccgcggaggttcccaaacttcaattcttgactcctgtgcacccacaggctcaataccacatgtaagccaccaatgcttggtcagggcttgaaccctctgaagcaatggcctgagctgtacgttgacaccttttagcctagacatctaggacacagggcaccatgacccgaagcttcataaagtgggagggccttgggactagctgaggaaaccatttttccatcctaggcctccaggcctgtgatgggaagggcagccatgaaggtgcctgacatgccctggagacgttttccccattgtcttggtaactaacattcagctccgtgtgcagcaccaacttacttatgcaaatttctgtcactggtttgaatttctccccagaaaacaggatttttcttttctattgcatcatcatgctgcaaattttcaaacttttatgctatgcttcctgttgaagactttgcggcttagaaatttcttcccccagatacccaaaattatctctctcaagttcaaagttccacagatatctaggggacaaaatgttgccagtctctttgcatagcaagagtgacctttactccagttcccaacaagtttctcatctccatatgagaccatctcagcttggacttagttgtccatgttactatcaacattttggtcaaagccattcaacaagtctctatgaagtttcaaacttccccatgttttcctgtcttctaatagccctccaaatttttccaacctctgtctgttacccagttctaaagtcacttctacatttttgggtatctttacagcagtggcactccccatggtactaatttactgtattagtctgttctcatgctgctaataaagacttactcgagactgggtaatttataaagaacagaggttcaactggctcacagttcagcatggctgggaggcctcaggaaacttacaaacatggtggcagcaaagagaagttccaagcaaagagggaaaagccccttataaaaccatcagatcttgtgagaattcactatcatgaaaatagcatgagggtaactgcccccatgattaatttacctcccacagggtccctcccatgacaggtggggattatgggaactacaattcaagatgagatttgggtggggacacagccataccatgccagctagagagccttaagaaagtcacctaatctccacaaataaaaggtttcctatttgttcaacaaaaataatgacaccccttttatgggatttctgtgaggacaaatgataactaacatagccttgcatagtgtctggcacaaaatagctactcaaaaaataatagaaacaacatttaaaaaatgtagactttattttttagagttttatgtacaaagcaaaattgagcagaatgtacagagagtttccgtatagcactccctacccccaagcacagatagcctcccccagtatcagcatcccgcaccagagtggtacatttattataactgatgaatctatattgacgtgtcattttcatccaaaatccatagtttatattagggatgcctcttggtgttgtaccttctatgggttttgacaaatgtataatgacatgtattcaccattacagtatcataaagaatagtttcactgtcctaaaaatctttgatcttcttcctattcatcactccctccccattaatccctgacaactactgctaattttcctgtctccattgttttgtcttttcctgaatgtcatatagtttaaatatacagtatgtaggattttcaaactggtttatttcacttagtaatatgcatttgatgttcttccatatcttttcaaagcttcatagttcaatatttatagaattgaataatattccattgtctggatgtactacagtttatgtattcattcacctatcaaagaacaccttggttgcttccaagtttcaacaatcatgagtaaagctgctataaacatctatgtacatgtttttttgtgaattgaacattttcagcttttttagctccattcctaggagtgcaattgctggattgtatgataagggtatgtttagtgttgtaagaaactgccacgctcttcctaactggatgtactgttttgcattctcaccagcaatgaaagagttcctgttgctccacatactcaccagcatttggtgtcgtcaatgttttgagcaatagcattttgatctaacttttcctaggtattctttttgaaggaaataatatgacagataatagagaaaggatatacgaggacagttctgtcctttatttatagtccatcatttaatgaaggactctgtccacacttggtatttttaactctgatcctcctctcccatgaactctgacaatctcctaaatccctgttgctggcacacatggttgtgtatcaggccccctgtggtctgtctgaagcatggctttttttttttttttttttttttttttgagacggagtctcgctctgtcgcccaggctggagtgcagtggcgcgatctcggctcactgcaagctccgcctcccgggttcacgccattctcctgcctcagcctcccgagtagctgggactacaggcgcccgccaccacgcctggctaattttttgtatttttagtagaggcggggtttcactgtgttagccaggatggtctcgatctcctgaccttgtgatccgcccgcctctgcctcccaaagtgctgggattacaggcgtgagccaccgcgcccggcctttttttttttttttttttttttttgagatggagtctgtcactctgtcacccaggctggtgcagtgatgcaatcttggctcactacaacctccatctttcaggttcaagtgattctgccacctcagcctcccaagtacctgggattacaggtgcccgccaccacacccagctatttttttgtatttttagtagagacgtagtttcaccatgttggccaggctggtctcattcctgaccttgagtgatccacctgccttggcctcccaaagtgctgggattacaggcatgggtcatcacatgtggcctgaagcatgactgttgctttaatcatatgaaatactgctctgtattgttatctatttgaaatgccacacctcctgagctaaattgcaagcttttatggagcacaaaccatatttatatatattagcatgataccatgacacatatcaaaagctgttatatattgttacgtgaattgattctttctcagttaagaggacctctgtagtagcactttcataccgttaatttttcattttgtgcccagcccctactctgtgaaaaatgaaatgaatcctgttatcatttccctcccaggccttttctccttgtggacaatgtgtggctcaagagaaaattcagtcagtaaatttgttcagtgcacaaactctttatcacctctcactgttctcaagtgagatagaacagaacatccatccagtgtcttacaaattgtctggtatatagtaggcactcaataaatgttttttgaataaatgcatacatgaatcctattcctatatatagtatggtagacagatcattgatacccaaagatgcccaaatgctgatccccagaacttgtgaatatgttacatttcatgtcaaaagggactttgctaatgtgattaaggattcagacccttggattgtaagattatcccggattaaccagggccaatctaatcacatgagaccttaaaaaagcagaaaacatttcccagctgggttagagagagatgagacagagtaaaaaggaaagagattcagggcatgaaaatgactctacccactgttgctggctttgaagatagaggaactaggccacaaaacaaggagtatgagtggccttaagaaataggaaaaagccctcatctgacagccagctagaaagcagtcctctgaccacaagaaattggattctgccaaccactcaaatgagcaaggaaatggattctcccctagaacctccagaaaggaacacagctctgtaatgccttgattttagccaggtgagacctgtttcagacttttgacctatggaaatataagataataaagttttattgtatgctgctaaatttgcggtagtttattactgaagcaatggaaagccaatacagacagaatatacagagagaaagagaatgagttctttcctgataatttgtaaatatttgggtcttcactggacaagcttcacagaggattcactggttccctagcaaaccagcatgtccagtcctgcagcctccctttcttaggcccagcatatgtcagctgtgtgcatagaaaaatcaaagcaggaccctgagtagttggaaagaaaagatggttggaaatgggttgcacttcaagtgaggaaacaagaggtaggagaccggcatctctttctcatatgtcccaggctgactcttgtgagttgttttcccttggaggctatcgatgacagtcacagtaacctgatggaacctggatcatgatgaaagaagtaagtgtcaatggctccgacttccaaggactctgatgtcccacagcactagctaaacaaagccagttggaaatgagcttaaatggggaatttcctgaatatattccctattgttaggaagccaggttggcttccttgcctacaattatgccaagcagtcacactatagagtccctagggacatgatattaagtgattcttttaacacaaacaacttaataatcatttatactaatagcaaaacggccaacggctgatattccacttgaagtagaattggctatccaactggaagagaagacaggaagacgtgatctccagggagccactaaaaggattggcacctgcctctggattccccttttccttatattacctctcagcactggcaggcctttatttcaggatacagtttcacaagtattatgtcacgtctctgagaattatgttggtagatatttgctcctctggccagaaagacctagtttggagtctggagtcatgaaggtgacatacatgtagctagtgacataagtgtagctagtaaaaatagtgagtaatggccctgaaattctattgaatgcccaaagtgctgaccaggaacaagcatgctctagcttatctcacaaggaacttgacaattttcttcaaaaatcctagtagctaagatttcttagtaacaaagccactaaggcacaattatgattaacttgacccttaggtgacttttaaggactattctataaaatattacaactaatagtggatccaagccagcacactctgctatataagattaattgacagtgtccacactggtaaaataagttgtttcataaatacattagaattcatttgcactttctacacagccccaagtccagaactttccccagaataggtctatgttttgcaatctgctactccatacagagatttgagttcacttggcaatttagtgctgcttatatgtgaccagttagtctgttttacttatctatgccttaaacattactatacttactaactccaagatgcctggtctcaacttgacaaaaataccccaagttgggaaatccttatgtgaatatgtagatagtcacaattgctggttgatgatgatctgtcttttcctgtatttgagaaaatggagataaaatggaccaatccaaataatggattaaacatgggaataggtgagagagagagaggaatacatggtggctctcagtgtctggcttaggcagtaaacactttcgttaataaagacggaaaataaaaaaggaataattggtgtctaggggaaaataatgagctcaagttttaacactctgagttcccggatgtgagacatccaggcgcatttatccaagaggcagttggaagcaacgttccggagcttaggagagaggcatgaccaaaagctggtgggactgtgaaaaggtatggccattctggaaaactgtttggcagtttcttagaaaattaaacatgtactaacaacccagcaattgtactcttgagcatttgtcccagataaatgaaaaaaaaaaaaagcattttttttacacaaaaacatatacatgaaagttcatagaagtgttattcataaaaaactggaaaaaactgagatgtctttattgagtgaatgcttaggcaaacggtggtctatccatacaatggaattatgcttagcaataaagagaaaagaactattgatacatgcaataacacagatgaatctcaaaggaattaatgctgagtgggaaaaaaagcacatctcaaaatggtatatactgtactattttatttacttaacattttaaaaatagcaaaatcatagagatggagaacagattaatgggtactgtgttttgggatggggagtgagaaaagggtaaggtgtaaatataaaggggtagcacaaaagagccttgtggttgaaggattctatgtcttggttgtagtcgtgattgcaggaatctacatgtgataaaattgtatgggtctacatacgcatacacacaagagcatataaaactggtgacatgtgaagaagctccgcacattgtgccaacatcagtatcctagtttcaatatcagactacagttatacaaaacattgtcattgagggaaactgggtaaagggaacacaggacatttggcatatatttttgcaatttcctgtgaatccgtaattatttaaaaataacagatatactacatatcaaaaatttaatgtcataaagttgatgagtttacctagtggatagctttgttaatatctgctataagactactgaaaatgacagttatgcaagtataagctcagagaactttcctcccccttcgtaaatgaaatgagcaaaagaaatgaaacaggaaaggcaagcagtactgaaaacagggaagggctcttccccatataactatatctgcgacttcaacagctattcatccagaaacacagcctcttgcgctaagaggaaactttggataacaatatgttttcactctccaagagagaaaatggatagattaatttttaagaaaaaaaaaaaaacctcaccaatttcatgctgtggcttgcacctttaatcccagctacctacaaggctgaggtgagaggcttacttgagcccaggagttcaaggctgcaatgagctatgattgattgtgctatcgcactccaacctggagtactaagctaagagctaagaacacagctgagagcggagaagaaacaaacaaatctgaccaataacccccactcccctcattttactggagtgagctgagactgctggcaaacatggcctttgacctagcctgaactgtagcaaaagtcatcagatatttttccaccaatcaacagacagaagtggggagaaaacaatcgtagttcataactacaacaagcagataaacgaaggccatggtgagggatggaagacattgtgatatatcaaaggcaggctcatttaaaactcaacccaaattccaaacaaaatatataattgaatatgtattaatgccaaaggagcttgagtgagctttagcacaaaccccgccctccagcccccacccaaaaaaatcactctgttctctccccattctttgataggcatacttgctgttttctcacagccaaggtacagaggggacttagaggaactagaactctaatacactgctagcaggaatgtaaaatgaagcatctacttcagaaaaccattttatcagtttctagaaagttaaacatagacccaccatgcagcccagccactctactcctaagtatttacacaagagaaatgaaaacgtgtccccacacagttgtatttaaaggtgatggttagccttgtgtgtcaacttggctaggctataatacccagttactgaatcaaatagtaatctaggtgcatctgtgaaggtattttgtagatgtggttaacagctacaatctgttgacttcaagtaaaggagattgctcttgatagtatgggtgggcttcatccaatcaattgaaggccttaagagcaaaaagtaaggtttcccggagagaaagaaattctgcctcaagactgcagcctcaactcctgcctgagtttccagtcagccagccagcctaaagatttgctaggcattataatcacatcagctaatttcttaaaataaacctctttatatatattgatacaatgaatggttatagcagccttatttgtaatagccacaaactggaaacaacctaaatgtccttcaataagtgaatacataaacaaattgtggtatatccacaatttttacgcagcagtaaaaaggaataaatggttgaataaggaataaacacataacaaggatgaaccttaaaaccgtaaggctgaatggaaaaagtcagacaaaactaatacatactgaataattccatttatattgaagttctagaaaatgaggactaacctatagtaacaaaaagcagaaaaattttgcccactggtgatggagggggcgcaggtattgtagagtatctgagaaaggacaactggataaaagggggcacaagaaaacttttgagggtgattgatatgttcattatcttgtggcatggtttcataggtgcatacatatgtcaaaacatcaagttatacacttttaaaatgttcagtttactgtatatctattatacttcagtagagaggaaggaagaaagtgggcagggtgggggagaggaaaggaaacgagggaggaaaggccctaataggaaggattttggagtttagattttaaaatgataaaggatgtttgacactctaggcatatgacgaatataggattatgagtccacaaaaaccaccaggaagtcatgtatgtttatacttttaagtgaaggatcagtggattatcaactccctaatgctttgcctctctatgactggctgctgtccttctcatcccaatactccttccaaagccccttgcttaaatgtaagccttctttcctcctttcaacacatcctgcattccgtgacaaaataagttttccttaaacagaatgtacagcatattatttgtacaattaaaaatttttggccaggtgtgatgactcatgcctgtaatcccagcaatttgggaggccgagatgtgtggattacctgaggtcaggagttcgagaccagcctggccaacatggtgaaaccctgtctctactaaaaatacaaaaattagctgagtgtagtgtggcaggtacctgtaatcccagctactcaggaagctgaggcaggagaatcgcttgaacctgggaggtggaggttgctgtgagcagagatcagactattgcattctaggctaggagacagagtgagactcggtccccaaaaaaaaacacatttttttttaatgtttcctccttgcctgtaggaaaaaggctctgactccttagcctgggcatcagagctctatctaaatggactttaacctgattttgtggcactaattccattgcagtacttgtccgctcactggcctgtgcctctctgccactatttttggaataatgtcctctctccatcttgtttactcaactatatccaacctctaaggctgtgctcctacaaagcctcccctggctacttcagcccacagagatatttaactgctctgcagttcaggacattcttctgactctttaaatcacatttacttatatatgatcttgtgatattttttgttgacgtgtttactttaattttcttccataacctattcattcaacaaactcaacaattatttattaaatgccaagttagaaaaatattattgattttatatagattatagatatgtttgaaattttatttggcaatctgcaagtagaaaaataattataatgtggtatatctgtgatagaagtattagtgcagagaccatggggaacataatccagcctggaagttcaggagagatacgtggaagaaaggacgtcagagcctttttcctacaggcatggaagaaacattaaaaaaaatttttttttttgagatggagtctcactctgtctcccagcctagactgtggtggtgcgatctctgctcactgcaacctctgtctcccgggttcaagtgattctcctgcctcagcttcccaagtagctgggattacaggtacctgccacacatggatgataaatatgatcatattttcttgttcttttcctcctcagttgtcttccctgaagaaaggaatgccttttatagatgacaaactcccattctcaagaacaaggatttttgaccaatttaatttaatcagatgtctggctttgacctagaaacacagtcacgaaacttggtgattagagaccaattcccaaacatgagcatttcttaggaaacacagtaaagatctgagagacccaagagcagaagggcgagaaaccaaaagccatcagtttgcataggaaacaccttgtttagcctaatctttttatttttattactctattagtcactacaactattttctgattgctatggtgatagatggtttaaaacaagccttcattaagaattgtcacaccatggtctcagtcaaaaacaccaacatttttattggtattgacaattatgggaatatccaattccaagaagacaaggagacctctgaactttctaaatgaagactccaatcttcctgatctgatgggaagcagcttggcaagattaccaaccaccaccacagagagtggactctaagctaagacttaaaagataagtagaaattatccaggtaaagatgtgtacagagaaggaagtacatccaggggaaaagaacaatacgtgcaaaagtacggaaatggtaaaaagtaatactacatagtcaaagccaagcagagttcagaagggatctggtggtgaaaaatacggctagagaaagcagcaaggattggcttctaaaacctatgtagtatcttggaccttaccctaaatgtaatgagaagcttctaaagaatctttcatttattcattcattgaacaaatattttgaggctttctgtgaagaacatcattctaagtagtaaagatacagcagtgaataggacacataaaatcctagatctcacagaattgacattccagagagggaaaggtagacaataaatacataaacaaatcatttaacaagatgatttcagacaatggtacgtactgtgaaaaaaatgaaacaaggtaatggacagcgaaaaggcactggaaggaagcctgcttacctttgcatggttagaaaagatctctctaagaaagagaccacatgtgagctgcgacctgaaggataccgagaagctaggtgtgcaaagatgtggggacagaacttttggactgaatagcaaatacaaatgcccttgggtgcaagctttgcctgttcaaggaccaaaaagaaggccagtgtgcctgcagcatactaagcacagaggaaaacactgttatatgctgagattggaattataagtagagccagataatatagtctcttataggtcataataaggcaaccagattttattccaagaggatttaaaaatcactggaggttttgcactagggtgagaggtgtgatttgtatttttaaaagataattctggagaattaactataatgaggtaggagtaaactaagttaggggctatttcagtggctcagacaagagataatggtagcttagactaggatagtagtcgtagaaataaataaaagtggcactctactttgggggtagagtctataataggtttggtttatggatcatatatgagagtaaaaaaaagaaaataaattaataatggttcctaggtttgtacctgagcaactgaataaatgggtgctgtgaattgagataaaggagattgagaatcacaggctttgttttgcaaattaattttgagaggcttattagacatcccagtggagatttcaggtgagtggagcccattgaaaggtaagggacagggtcaggtgtggtaggtcaggcctgtgatcccaggactttggaaggccaaggcagacagatcagttgagctcaggagtttgagaccagcctgggcaacatgggaaaaccctgtctctacaaaatatgcaaaatattacctgggcatggtggcatatgactgtggtccaagccacttggggggctgagatgggaggatcacttgagtacaggaggcggaggttgcagtgagccaagatctcgccactgcaaaccagcttaggtgacagagtgagaacctgtctcaataaataaataagaaacgtaagggaaaaggaaattaatctgatcattggcaaatgcatagtatttaaagccaggggagtagatgagatactcaaagtaggtgaagataaggaggcaatgaaggcctaggactctggtgtacatttagatggttataagaggaatagaaactggcaaaataagtaacactgagcacccaatgaggtggagaggaaagccaggagatgaagcatcatagaaggcaagagaagaagggtgtcaaagaggcgaggcagtcatcaacttctgggcagtcaaataatataaggacagaaaagtgaccattggatttggaaatatgatgagcactttgagtggagtgttgagacagaagaccaattagagtagattgaggagataacgagaaatgagaaaatgtaacctgcaagcacagacaattcttgagagacttttctgtgaaaggaaacagacacagagtcttagcatgtcttgtctttctatgggaaatgtaaatagtttgagatcagggatagtattttattctgctttttgtacctctacattacctagcatagagctagctaatgtgcacttaagtatgttctcaattcttatcgcctgaatgactggatgggtgaaagaatggatggatggatggatggatggatggaaggatggatggatggatggaagacttctgatttgccaagaagaggatactggtagcagaaataaaaacagcactggagaaagaagagtttagatttttattctttggtgtcagttagacaggaaagtaagacattagaagagtccttagataatttatgtaattgttcacttaggatttttaaatgtgatcactgatattggacatgttcctagtgaagcatttttggtgtttcactggttgaagttaataactgtaaaattatttcccgttcaggacagaaaaacagaaaacttgaagctcctattagaaagttcaagattctctggggttcttaggatttactgttcccaaaactctgtcaagaacaagaaaatgacctgtatacttaactggtctaggcaacagtggaaagacaattctcagagaagatttgttttaagaagacactttccataggaatcaaacaatagctttcagtgactaacatggtaagacacagggtgttagctctttccttccaacctcatggctgttgtaccttacctttcgaccccgtgttcctgaaattgttaaattcataaacttaccaaggactaaccagcctctggggaattgctgtatacttagcaaacttacaatggacatatttataagccataatgataactgactaataggaaataccctcaactgaaaatgagagatcatcatttgcaaatgagttcccttgcccaggcaactactggggaaaatgtcatgcaagcaaaattaatctttgaaatcctccttttccattttttgtgtcttccttttccataggcaccagaaatatcatggtgcctggatctcatctctacagaaaaaaaaagtgatttgataaactgatttatattgtgtccaaatgtgattgtattttcaaagataacctaaggggagaatgctgtctggcccaacagcaggctctcgacttcatttcagacactgtggccaatggctgggaaacaggtatgaacagtaggtttctgagtcccctggaattattccatttatgtagccacctccatgacaggaagcctccctactcttacttcccagtttgttcattcatggcaccaggttgcagattaaaatttgctcagtgaccttttatctaataatgtgttaccttcttctcttaaaaagtacaagggacaaatgctcatggtatacttttaggagattgtggctctctattaacagtatttattcaacaaacatttattgagcatttatatgtgcatcatgctagggactggaacctagtaagtgtagcacatattatttcatttaatcctcacaacaaacccatgaggttggttttatgatcccaatttttcagaagaagaaactgatattcagaaccagttaactaactggttcaaggtcatgcaatttctaagatacagaaccaagagtcaaagacatgattttaaaccaaagctttttctgctactccacattgcttccctaggtgagatctgaggcattccgcgaaaagagaagggtcataaagccaagggaagacaagcttaggaaaaaaaagggaaatgtcctaaataaacagctttcctatttaccagaaaccactagtttaaaaatataatgggaaaaatcctattcactttaacaatgttaaaaaaaaaaaagatagaagaaacatagggataaacttaacacatttgtaggatatgtaaagaaactaaaagatgttaataatggcctaaagaaaaaaaaacttacatgtatggggagatagaccatcttactggattctaatatttaatagtctaggtgttccatttctcaccaaattaatgtatacatttaatacaatgtcaaacgaaatatcttaggaattgcttacaaattgtcagataattacaaagtttacctgggaaatataagcatatatgaagagtgaatgggaccccaccactccccccaaaacaaaaaaggtctgaaaaggacagaaatcaaggagagtcttgcctgccagatacaaaattctattataaaggtgtattgatgaaaacaatttaatactagtgtagcaataggcagcaaagcaatgaaacagcataaaaagaccagaactatacctaattatgatgaagatttaaggtatgataaacatgacataattcaaatcagcagaaattggcatagatagggttaagacaaatagctaatcattagaggggaggaaggaaaggagggaggataaaattaggttcctgccttcatcttacattaaaataaattccagatgtattacatttaaatttttttaaaaaaagaaaccacaaaatacttgaagaaaatataagttgttatatagtcttttgatgggaatttttttttttttcagagacagggtcttgctctgtcacctagcctagagtgcaatggcatgatcatggctcactgcagccttgaactcctgggctcaagtgatcctcccagctcagccccccaggtagcaggaactacaggcatgcgacaccccatccaacttattttttattttttgtagagacaggggtcttgctttgtttcccaggcttatctcgaacttctgccttcaagcacctcagcctcccaaagagctgggctgatgggacattttttaacatagtgccacattaccataaatgaaaagcttgtaaaatactaatttttaaaactaatatatatcagaaatttttataaacaaagttaaaaagcaaacacaaaaaatttgtagcacttatgacaaatatatgtatatatatgaatacaaaaagagcctttacaaaacagtaagaaaacaatgaatactcccaatggagtattcaaaactaaactgctaaaagcaattcaaaacaaaaaacataaactatgcatatatgtatgtgaaaaagtttaaccttatcaaagaagtaaactctcaaagaaataaacatcaaataaggaaatagccttttcccacaaataaccaaaatctgtaagaatactgagctgcgaatgtttcagaaaaaaaaaaaaatcatacacctagttcggcatgtaattaatatagatcagaacactttaaaaatatttataggccaggcacggtggctcatgcctataatcccagcactttgggaggccaaggcgggtggatcacctgaagtcaggagtttgagaccatcctgaccaacatggtgaaaccctgtctctactaaaaatacaaaaactagccaggcatgttggcgtatgctggtaatcctggctactcgggaggctgaggcaggagaattgcttgaacccaggaggtggaggttgcagtgagctgacattgtgccactgtactccagcctgggcaacaagagcaaaactctgtctcaaaaaataataataaataaaaataaaatatttatatactctgacccatcaatttgtccagcataattaggcatgtgtacaagggtttacacacaagaatgcctattgcaatattgcttttaatgctaaaaaaaattggggaaaatgctttaaaaatatagattaagactgtacattgtggtacagtcatataatcaatagtatacagctattatttattttcagccactgtccaaaatatagcctggcctaacaacattctgttaggatacgcaagcaccgtgaggagatcagctataaagtatcagtgtttcacaccactgctcctttgctaataaccttcaatggcttttaaagaagtaaaaaacaaaggcaaaattccttagtcagcccttaagactctctgttacttagctcaaactacccttttcaacaacactgccctaaccaggatgagttttttgcccccctggagtacattcagcctttccttatcaaaccttcctttaaataagtatcttctccaggaccacttcactttcttccccaatttagcattttctatatctccaggcctacctctataaagcctgtcctaaccactcaaaccctagctttttctctgaactgctagaaatatttttctctcattggccatttaggtaaaaaggtttttactgtttattacctactcaataaaaattttctttttttgagacaaggtcttactctgtcgcctagaatggggggaagtggtgtgatcacaactcactgcagcttctacctcccagctcaacagtcctcccacctcagcctagtgagtagctgtgactacaggcatgtgccaccataccccactacttttcattttttattttttgtgagatggaatctcactatgttacccaggctggtctgctgatctcaattgatcctcccactgtggcctcccaaaatgctgggattacaggcatgagccacaatatctggccccagtaagcttttaaggccattaacatgaggaacagtgttctttacactattttatcagctagggctttgcatggagtaggagtttagtaaatgcggttgatgggttaatcaatgtgtgaaaatattcagagccaccaaaaacagatattatgtctattctcatcaacaatcaaaattgagtaaacagccattttctaatacaggaaaccacaaaacattgaatggtgacattaaaaaattcccccagcaggagccaaccaattttttcatcctgatccaagttagcaaactgcaaaagataggaagcactaatgagtggaaatttgagtagaagcatttcttatgaaggctgtcttgactggatcacatttttattgctgttggaggtgccaaatgtgtgtgtttatgctaatcctccacctcaggcaacacacagtcaaggatcctaccaagtgttaccgtcaagtgtctgttggcagctcaaggccccagcgttgttcccttgcactagggaaaagacatattccaggtacaagtactcccactttgatgctacagaggagttgctgaactttgtgtcattaatctctcttcgttagatcccaaccctgtttaaatcccactatctgcctactctgggtcttcaccaatttactagatcatagttggagaaaatctacaaagccttgctccctttagatttaaacaggtctccgtttaaatttagaattgctaacttcaagcgggcccttatgcgacagtatgcctgtcagtcatactacatttcctcaattccattcatgtgactgctccatacccttccctctctcttcatactactattatctcttcccccctccctcatttttaactgatgatcttgtttcctatttctctgagaaaatagaagccatcaaaagagagtttccacaaactcctactgccttatctagccctgtaccatatactttgcatttcctctcattaccatggatgtactgcctatctgtgcttctatctaaggctaacccttccacttcagttttgaatattatcagctcttaccaactcaaggccattgctctagcaattctctcattctctctcattttcttccatcaagttttccttttcttcaattaacagagtagctcctaaagggaaaaaaaagtcttctttttcaatgctcatcatcactggccatcagagaaatgcaaatcaaaaccacaatgagatatcatctcacaccagttagaatggcaatcattaaaaagtcaggaaacaacaggtgctggagaggatgtggagaaataggaacacttttacactgttggtgggactgtaaactagttcaaccattgtggaagacagtgtggcgattcctcagggatctagaattagaaataccatttgacccagccatcccattactgggtatatacccaaaggattataaacaatgctgctataaagacacatgcacacgtatgtttattgtggcactactcacaatagcaaagacttggaaccaacccaaacgtccaacaatgatagactggattaagaaaatgtggcacatatacaccatggaatactatgcagccataaaaaatgatgagttcatgtcctttgtagggacatggaggaagctggaaaccatcactctcagcaaactatcacaaggacaaaaaaccaaacactgcatgttctcactcataggtgggaattgaacaatgagaacacttggacacaggaaggggaacatcacccactggggcctgttgtgggatgaggggagtggggagggatagcattaggagatatacctaatgttaaatgatgagttaatgggtgcagcacaccaacatagcacatgtatacatatgtaacaaacctgcacgttgtgcacatgtaccctaaaacttaaagtataataaaaaaatatatatatatatataaaacaactaaaaataaatcttctttttctgcaggatcagtccatcaccacacacacaggctgtgttttatgttgttccccagcttaagagatcgttctccagatcccactgctccttccagttgtcacctcagttctccacttctttttgctgataaactactctaactagttacatatgatttctgtccccaggtcccctccctcagttgttttgaacataatcatttatatcatttatcattttcactctaattgcacaaccaaaaactccctttttttttagatggagtctcactctgtcacctaggctggagtgcagtggcatgatctcggctcactccaacctccgcctcacgggttcaagtgatccccctgccttagcctcctgaatagctgggattatacacatgcaccaccacacctggctaattgctttgtttttgtttgtgtgtgtgtgtgtttttttttttttttggacagagtctcactctgttgcccaggctagactgcagtggcatgatctcagctcactgcaacctccacctcctgggttcaagcgattctcctgcctcagcctcccgagtagctgggactacaggcatgcaccaccatgccaggctaatttttttgtattttcagtagagaccaggtttcaccatgttggtcaggctggtcttgaactcctgacctcaaatgatctgcgcacctggacctcccaaagtgctgggattacagacttgagctactgcgccgggctattttgtgtttttagtaaagacggggtttcaccatgttgtccaggctggtctcaaactcctgacctcaagtgatccgctcgcctcaggccctcaaagtgctgggattacaggagtgagccaccatgcctggccataaaactgccctttgttaatatgactgttggcctgcacattgtcaaatccagtggcattcatcttactcggccaacctacggcatttgacactgtctgtctttccttctgttcctctatctgtttccagtatactggcctggctttctttttacctcttttatatgctcttccagtctcaggctcctttggggatttgaaggtatgttgcattttgctattcaatgaataatgacaagtaatgatcacttaagacattaagtggtcagttcctttactaggataaaaataattttcttcccaacatggggcatattccatttccagtctgactgttctgtgtaatctttgtattccttggcagccccttttatatcagttcatctactgtgcaggaaattggacaaacatttgcactggtataaccaaatacagttgaacttttggcttgactcttagctgaactcaccaaaaataatttctgtaagagactgagacgtctacgagtaggtttttcagaattagtaaacataaatcaaggatacacaggtagatttgaatttcagataaacaacaaatacttttttagtatgtctactgaaatatttgtatcttatctggcaattctacctggtacagaactaatccattctcttgaaagatcttgactctgtaataagttctttggtgatggaagggaggtatttctgtaattagagtcactgtcttcctcccagttttttatcctggcccagatctgcaatgaacacacgacagaatccaggggggatgaagatgggtgctttgcaggaaaaaaaaattaaaaacatctgaaaaagcttttgtactaaaagaatgtgatctaaaaaagaaagcaggagaactttctgtctgcactttacatcagaacaaccttggcgtctagaagctgtgccctgtgggaagtggtggtgcttggtaagagatgccaggaccagtggtacccactgggagcactgccaatacccagcaaggagcatgggtgcacagtaaggcattgcactgtgattcagcataaaataacaataagggaacgtcacggagaaaaggccagacttcctttgtttagaatgtgggaaatgtcttctgaaaaatggtagtaaaaaagcatgcttggatggtccactccaggcaaaactgactaatcgggggtcagggatacaacccctgcatcatatgtttgtttctgttgggctgacatgaggttcactgtgaccactgtggtttaaccccatagtctcctggaaatacagccaggtcaagagagctccacataaaacataatcaaaaaaataaactcaagtttccactgatcagcttttcacaactcttatcctttcactaactttggagcaagatttgagaattggatggctatttgagggctatttctgcgctttagttcaatgttttgttctttctttattagagaactatggttttttattatatttacactttaagttctagggtacatgtgcacaacgtgcagatttgttacacaggtataaatgtgccatgttggtttgctgcacccatcaactcgtcatttacattaggtatttctcctaatgctatccctcccccagtcccccaccccccgacaggccctggtgtgtgatgttccccttcctgtgtccaagtgttctgtttatgtgatagattacgtttattgatttgtgtatgttgaaccagccttgcatcacagtcacttgcttacaagaaacaaacacttcacagatggatcattatgtgtgataagtgaaatccaaggatttatgctcagaggtgggcttaacaggtaggaagagcagtattttccttcaaccatgagtgtatgcaggtttttcttttcttttttgagatggagtctcactcttttacccaggctggcgcgcagtggtgcgatcttggctcactgtaacctctgccacctgggttcaagcaattctcctgcctcagcctcccaagtggctgggattacaggcacctgccactgtctccggctaatttttgtctttttagtagagatggggtttcaccatcttggccagccttgtcttgaactcctgacctcatgaatcatccttctcagcctcccaaagtgctgggattacaggcatgagccactgcgcccagcccacaggtttttcaaagactaaacttaaaaaaaaaaaaaaaatttcccaatgaaatataaaactaaagtgctaaactgtgatagactgttttacaagaatgccagttttcacaagtgtctatagaacatgtaatttagataggtaagatgaaattttgataatatttgatggcaaatttaaacaggtatacaacaaaaataaaattctaagcccctcaaccaactgaatggactccttctctcagccaaaggaataccaaagtaaacctgaaaaactagttttggccaggattgggggtaggtgggggaagcccaacatgactcattattctctcctccctttggaattcaggcacaactgaatgtcagcattgacactaaaacacagatcttaagactgacaagccagactctttgtagcagagagccaggccctggaagaaatcaagttattttatcccaaaaaatatttctttgatatattttcaaatggccctgcaaagctgtctcttgtggggaaaattgacatgctgtacagaatttccttctctttccaagtttttactgatccaggagagatttaactaagaggctagcatgtttttttttttttttttttgaggcggagtcttgctctgttgcccaggctggagtgcagtggcgtgatctcagctcactgcaaccttcgcctcccgggttcaagcgattctcctgcctcagcttcccgagtagctgggattacagatccatgccactatgcccagctaatttttgtattttttgtagagacagggtttcaccatgttggccaggctagtattgaactcctgacctcgtgatccgcccacctcggcctcccaaagtgctggcattacaggcgtgagccaccgtgcccagcacaagacatttaccgtctattctctctgaagctactatctagaggcttcatcaacataataagacccttggtctccacaactccttatcttatcctattagtttctactgattccaggtctttagataataacaactctttcaaccaattgccaatcagaaagtctttgaatccacctatgacttaaaagccccactccttcaagttatcccgcctttctggactgaaccaatgtacaccttatatgtgttgatggatatctgcctgtaacttccattcccctaaaatgtataacatcaagctgtaacccaaccaccttgggcacatgttttcaggaactcatgagactgtgttgcagaccttggtcactcatatttggctcacagtaaacttctttaaatattgtatagagtttggcttttttcattgacacaggaaaaataaagaattggaaggtctttcatcagtcactgagccagcttcatatctgactgaggtcatacagttcagtgatttgtagctttgctacttagattgctatccattatctagaagcatcaggatcacgtgggacctattggaaatgcagactttcctcctagaacccaggaccttggaatattcttggcacatagtaggtgctcaatacatattgaactcctaggtgcaattcattaattcatgaattaatgaattaacacgctctcaaagtttagtgctttttcacagactagtctttctgcctcttaagcactcagctcaccacgcttccagtctcactcccctattagtctgattaaaatctgcttacatgtgagtctgagatcaagtgttatctcttctgagaagtcttccctcactggcccaaaggaatttctcctctattttagcactgtcccagttgacttgtcattattctagtctttttcatattagttgtttttcatatatatgttattaaggaaactagtcatttcccctaatagaacaaaattgctggcctttggggttggcaatggaggggaggctcttcttgaaaagggggaagagtgttctcctaatatttttcttacgagatttatgttgctcatctttagcctttagtcccccattgcctgcctacagttggcagagaccatctgttctctcactgtcaggaactgtctcaattcttgaagttcagagtcaaaaaagaagcaagttttcctagctctttgatcaactttcaaagttttacttccatttgaaaatttactaagtcaccaggagatggtttatactgagaaatatccactcatactcttcctcttcaactttcttccatatacaccctattacagggatatagtcttactctatagctcaaaaggatgaccctatcagaaacctgcacagtatgtaaaacattctcaccagaggttcacttgtgtatttccaccctagaatggaagctctacaaaagcacagaatgtatcattttaactttagattctattttcacacccagtgcttgacacatgatttgaagttaatatttatttatcaagtgattgttttaaaatcatgactcactcaacaaagttataagaataagaatagtgttacagaattggtatacacaagctgaccataatcaacacacctattatcatttttttgcgacaggttctcgctgtctcaccctggctggagtggagtggcatgaccacggttcactgcaggtttgaacttccaggctcaagcaatcctcccacctcagcctcccacatagctgagcccacaggtgtgtgccaccatgtccagctaactttttaattctttgtagagacagggtcaccctatgttgcccaagctggtcttgaactccttggctagagagatcctccctccaaggtcccccaaaatgctgggatctcaggcaagagccaccatgcctggccataatcaatacacttttaagaatgctagaatgttatatcagatgcatacttcagcactatctcaagcaaactggggtgtgggttattctacatataaagttcagcagtgttgttccacagtcccaaactccaactgaggtcaaatgtagggtgcagcaaggtcactggggctgtcatcaagggcctctccttgcactcttgccaaccctgtttcttgattgtctctaccaccatgagtcaccagcaatctcccacagtcacttgtttaaaagttcacaagtattgtgtgaattgcaggcaaccccttgactccctgattgcctggtcttcttccttgggctctaccattttttttccccagcactctttctgctgctctaaattttaattcatgcaattccatatgtgtttctctatcattcttcatctctttcctctcccttccatccaattttgtttgtctgtttgcttgcttgcttgctttaatacatttctctttttctgagaaggcttgagtccaaaactctcagttacctgttgttctgtttcccgttagttaatctccgaaccttcataaattaaatctgacaaagtcccctgactaacaaaggaaatgcacaagtcacagtaaaaggggcacacacagaacacaaatagacccagggtcttttctgttcatcactcagctttttataggagatccaggagaaatgaagtggaaagggaagtgtgttgagttactatacaacacaagagtaaactttcttataagtggtaatttttttttacaggaataattgaaaatggaaattaccttctctactcatagtaagtactcagtgcgttcttgatgggatgagaatgtgtttgagctttagtgtaaggcagaattctgtttagtctgccagtattggagaaaaataaaacacaaagggactgacatgtaggaagtggcacctgggagggtctcaattcttcctattacaaaaatgccccagagaaataaaaagcttgtgtacatgttgagatgggagagttctctggcccccctcgcaggatgtgtgacagtggggtggctctctgctgcgccaccatgagctcaaacccctcataggagggggagcacacaggcaggaaggtgcaggagctgggcgagctctttgggctctggccccgtggtactgtctagaggtgggtgcctgcaactcctgaaagcccaagtgggcatgtgttacagtgcactctttcagctttgctgtctgcagcttaagcgttaaccagctcagtttcttcttggtacccaggtccttgtctggcatccaggaagaatcaggttacacatggacttgaaggatgaatgtgggagttttatggagtggtggaggtggctctcagtgggatggatggggagctggaagggggatggagtgggaagatgatattctcctggagtttggctgtccagcagccgatctcctctccagtcgtccccagcctctcgacgttcagatgctcctcttctctccttctctgccatgctgttctgccgttcatctgcctgtctctctctggagcctggaatttggggtttatatggtacacaataaggggcatggcaggccaaaagggaactttttaggtgcaaaaaacaggaatgcctcttctcacttagggctatagattttcaggcttgaaggtggggcctttaccagcgaacctgtatttccctgtctcctgtgcatatcaatgtaatcaaatactgggctgatccaggatgtttctttagaccaattatgggtaaaataatttacattcaggtttttatatttgcttttgtcatttctttttaagcaatcatgtaaaatatctatacgacagtaatagatgatagcgaacctaattaaaattaccagaaacttaagaatctctaatgatttcaactgtaactaaggttatttctctttatgttgaacaatgttgggagataagacacaagagtttctgaagtatttcagaaacacaaagagggaggttatataaataatatttttttcctactttgggaaaatgaaagctagtcacaaagttaaacgagtggttattttaatatttaaaatacaggcttggatgtatttcctgttaaagaaaataaaatgcagaatattcaaaacgtctgaccacccttctaagaaaatgcatctctgaggtatttttccttagaagttattgtaaaaatcctggagaagcttgaacacagcaaagcaaacaggatgcagagtttaatctgtggaaagcttagggaagaaaagcaaatcattaaaaataggtcttcctctgaagatttttaaaacgcaaagagggtggaatagcaatgataataaaaaagctggcatagagagtggcacaatttgctgtgccactgagctgactggatgtgttctgaatttctaggcattagtgtacctttccacacgcattctccctttaaaaaaaatgcccacacactgaatacttttttcatgcaatttaaaataagcgcaccatctagtttacagaaattcactagaagttatttatcctaaaatagcagagatctagaagaattttgagctctaggacattttagacacacagaaagaagaatctggacaagtcttgaccagacatgacagaatagaaatttcttttcctatttatctctttgaataaaattttcaggatcttacagtggacaagtttgttatctacacattgtgaagcacattgatttctcctctgtagccttaggaagatctgagaggtgactgagctgattgaatgatccgtgaccgctctactgggaccagtagtagaactttactggtggagacctgctggaggtttgagagcagactttgaaaattactagagctacacagatactgtgtggctaactggattatgtttagaggctttcagaactatgctgctgctgctgcagtgtagccaggacgcacagagaacatctaaggctcttgaatggggcgatagggacagatttcagcagccatctgacttcagtgctcattttgatgctttccctgcagggtgcagtgtgcagtgtgcagtgtgcagtggtgggaggctcacacaggaatacttgcttctgtagccctaatttccggttcaaactctgcattcaccttgacagattctttccttggccaaaatttagttaggcttctgggctttctcttatgcccacctgcagactttttggtaaaatccagttttagtaaagagctctgctaagtcagtttagcaagaatccccacctcaaaagtcactatctccctccctggtagtgtctggcttgtcttcagcgagaattctattaggttctgttagattagaatcctccttacccttgatgcttcctcttagtattttttcatccactgactccttgacccaccttgctcctcggctataaattcccacttgcccatactctgcagttaagactattttctccccactactgcaaaatcccattgccatggtccctatactatctcaatggtaatgaataaagtctgccttaccatgctttaacaagtaacattgaaccatttttttctttaacaatctgctgcacaatgagattactaaaactttattccattttgccatgctggatgtcctcaatggaatggctcttgtgagcaccaaatcattgtgagaaggaaaacccatctcttacagccccctgtaacgtgatgtatgttacatgtgatgtatgttacatagttttttttcatgttgatcactttttgcccattttcctatatcttatcagttggaagactgtggaagtttgtagtactaagccacaagatgactaagaagagttgaaagggcaagtggggctaaaaacagattttgtttgacttaccccaccattccccctatcatggggctgaatctgcctggaggaaggagcatctttatctttgtactgtgaaccacacagtctagcagcagcacagccaaggcacttggggtttcatgagactaagtacatgcaattctattgtaaaggcttaaaatatatacaactgacccttgaacaacatgaatttgaattgcatggtcagttatacgcagattttcttccacctctgccacccctgagacagtaagatcaatcaatcctcttcctcctactcctcagtctactcaaagatacttgaagtctacttgaagatgacaagcacaaagacatttatgatgatccacttccacttagtgaatagtaaatatgttttctcttcctcctaattttttaacactttcttctctctagcttaatttattgttaagaatacaatctataatacatatgacatacaaaatatgtcttagttgactgtttatgttatctgtaaggcttcaggtcaagagtatgctattagtggttaagttttcgaggagtcaaaaggtgtatgtggactttcaactgcaggggggtgggcacccctgcccccatgttgttcaagggtcaactttactgccaaaggcaagcctttacatccactttttccatcccatcagtaaatggaaaaagatagctacagtatccctgcgtcaaatctttttttttgcagatcacaaattggccactcaccttgctctgtgaggggtaaaatgccccactttctttagtaatatttaagttagataatatttaagttataaagttgttctttgtaatcgttaattgtaatttttacatagtttctttcaaacagaaatagcatttttgttagataacctcccgtatagatgatgaaactccttttaagggctatctgaattttaattccttgaaaaggcagaaattggatagctagtagtcataaatgtactgtggcttcccccaaccatctgggctatatagaagctgcatccttggactgcagtagaggagtcttacaaagcacagagcaacttctctcctgggttgcgctagttatgatggcaattttaaatgtgtacttttacccaaagaaaatccttattatcaacaatcacaatgccatcataaccatggtataaaaaattcaaaatgtcccagctgaagtggaggcaaagactcaagttcatggagtcagagtttccttgctattcctctttttcaaatgaccatttagtaagcacctgaagaaaatactatggacggcattgaaaagtgaagataggtttaatcttctcgaaaatctaattctccagatgaaacgctgacacttatccaccccacagaccctatagcagatgtgtcactggccatcacatttgacacagagaagtcataactcagtcagcacagagacatttccatgagtttctgaaccatggacagaacgtcgtctgtgggacatgaaaactggaacttagaggacaggcacatctgagaaatgggcagtttaaaggcagaacatagcacatatgtgactgggttttagaagcaaatttacaagacgcactcttcttcatcctaaataatctgcaaccaaagcttccaaaaaagacaatttaggaatgcagaggtgaggagtagggaggggaatgggatgagagagagtggagattaatggtgggcagagcgaggtttagaacttagtggtttcttcaggttctgaactgaaatttgtatactgtaaaggcacaaacaccatttttaacaaaagtgagcaggacttcctatctggttcagaaaataggtgaataaatagtacgaattattaaaaataataatttccacttatacataggaaacttgataggaaccatgataaatgcttaactcttaatcttcaaggaactctgctagggatataatattataaatcttgttttgcagatggagaaattgaattttaacccaagttatcataacccttaaatgattaaatgatactgttacatgagaaagctgcgtatctgtttcctggatttgtagccataatttgtgtctcaagtcccttttgctgccagctatcttgggtaggtgtgttccctttgggctgtttgatacccccacatttatcttttttttttctctttttttgttgagagagtctttccctgttgcctaggctggagggcaatggcgcgatctcggctcactgcaacctccgcctcctgggttcaagtgcttctcacgattctcttgtcccagcctctctaatagctcggattactggcatgcaccaccacgcccacctaattttgtatttttagtagacaaggggtttctccatgttggtcagggtggtctcaaactcctgacctcaggtgatctgcctgccttggcctcccaaagtgctgggattacaggtgtgagccaccatgcctggccccaaatttatctttaatgccccaaattatctagttcccatgactgggcttctgctttgatcctttctgcacttgctggaccctctccctgggaaatgagattgtgtcctgagcccctagttagaggctatgtctctgctgttcctgaatgggcctcctggatgagacctcattaaaagtctaattctcttggagaattgagagatacctatttgtctcaaaatcattgaaaccaattaatgtattatgagcctctatccagtgatttgtacctcaattccccaatccagctgtcaaggccaatttgttctaccttacctagtaggtaagtctggaattgtagctgtggcattttcagtaatggtactctaggttagcagtccccaacctttttggcaccagggaccagttttgtggaagacaatttttccatgaagggctgggcaggggagtggtttcaggatgaaactgttccacctcagatcatcaggcattagattctcacaaggagtgcgcaagctagatccctcacacatgcagttcacaatagggtgtgcactcccatgagaatctaacaccgctgctgatctgacaggagacagagctcaggcagtaatactcatttgcctaccgctcacctcctgccgtgcagctcagttcctaacaggccacggaccagtactggtccacggcgcaggcatcagggacccctgttgctaggtataagcatctggctgctgcatgtcttctgtgtagctacatctgtatgtgtatctgatgagatataaattatttgattataaattactttcttcatattagagttgtgaatgagtatcacatataattatacataaactaggaatatgctttttaataatgtatataagtaagtttccttaactatgactttcatcttagcgtagtaagagggtgctaagaaatatttgtgatgaaaataggcattggtagagttgagaccactgggtgatgaaagagtgtaaagattttaaagccttcagatgctggttcaaggtgagaaatgtgattgggagcaaatcaattaacttcttgaagtcttatagggcagttatgaatacttaatgttaacatatgtaaagctcttctgccctgtatacagtaaatgctagttagctattatgatcactactaaaatggggatgacataaacctcataaggttttaagtattatgcaagatactatacaaagtccagtaaatatcacattcaattgaatccatgatgtccgattattttagctacttccaagagagaaaaaaatgctgtcagttttactgttcttatagagagcaaggcagatcccaattcccaatgtggtaacgtgaaaatttttgcatttgaatcaacaaaacactttctcctttctttcctactatttaacaactggtaagtctatactcccccaaatctggaattctcctttcttattctttttcctcctaccaagaccgcaggatcttttacttggctataaggggtaaacctcaagtagtacaagttctctgtattacttttatactctgtcacagattccctttgtttcctcatctccatgtgaatttagttaaattctcagcattctgatccttactatacaaggtaaatgaatataaaaacaaaacgaaacaaaaacctcttcctatttacataaggccccaacctaatatttagtgatatatattaatgtgaacaaggaactaacgaagactgggaagaaattcacagacttgagagaagaaatggcaggatttcctgggaacaatttcatgtaacgtcaaaggtggtaaaaggtcaaatagaatgaagatggagaataccggattttcttacaaaatgatttcccaggagatctcatcaaatgcacgaggataccttctcagtttcacctagtgagtaaaagactggtaacatagctcacttacaatttggataaacaaaactaaacaaacaacatcaaaatttcagaaaaaataatagcaaaacagaaatcaaacactcaaatttttggtccttctgtttatttcattttggatactcagtgaatgttaattaaccaggaaacttaaaagttatttcaattatgaacctcttcaatccttcatcaattattttgagtattctggtcttaaaaacatctctttcttctacaaacttctgaaagagatgaacacctccacctacaccaaaataatgtgctttgctggccaaaagtacacgtccatttttacttaacagtctaaggaaagtctggtgcaaattactataataatctgggttgtaaatggtttctgaggtgagaatgagatcatattttacaaaaagtttttcactacttagtacaagcttacaaaactcagaccactcaccagaaaaaaatcggcatttatatagttgtgttacttttggtttcctgcatcttttcacatctggctcatttacatcattttcttcatcttccaaagtggagttagctactacattaggtaaggttacttcatcaatcaccatactgttataatcttgaaagtgaatttctttggaccctcccttgaatgcagttatacctagtaaacctgatccacaaccaagatccaagacttttttcccagcaaatttcactttggcctttgtgaaataagccaggaggtcaaaggtacattcccagatttttaagcctccctcataaacacctgtaatcagatcagagtgagaagaaaagctttttgaaactatgttttctccagggaagttctctttcaacaagatggttttcactactgataacttaacatgctggaaacctggtaatgtttctatgactttattttctaacatcttctttaaatctttaggcatagcatgctctttggcagctctcaaggagggctgttttccatgtggctccaagttccttgaactgctggctgcactgagtggactgtctgtgtcttgagagggagctgcattttccattgacttatgttcccacaagtgatcctgaggcaagtcaaattgttctgcagaacattttctgtccctctcttctcctttttgactttctgagactgacagctcttttgaggaatccagggtcaaagctccatctctaatgggtgttaattcattttccagatggtcttctatagtgaaattaaactgaaaggtcatcctcttattaaatgcacacaatctttaaattcagattcttcaacttctggatagaatttgatgatacacacaaatctgcctcaattattcaattagttttgttgggcccaatttctctttagcagcttatacatggtaacaaatatttagagatatttccaaatgactttttagacgtctttggtcctctttccaagcagctctggaaagaaaaaaaaaaaaaaaagaaagaaaatgatgattaaagcaaaatggcacatttcactaaagtgtaatattaaacagccacccccacccctccctgtcccaccatacagctgctttttcttaaaaagttgtggggaagagagagagataagagatttggacactcatacacaccttaagggttccaaagtgggagaagaaaatcaactataaaaacaaacagaagaacaacagcaaccaccaccactaccacctggacaaacataaagtccaagatattcagacaggacagcctagctacttgctgtctttcagctgtcttgatttgtgtccaaccatattcaccccctaagcttccagaataacttcacttctgtcttttacagaagaggtgcagtattttattttggtaagtcagcgtccctttaaaaacatgcataggtatggcctggtgtgtgtaaattcatccaagacttcactccaaacatttagtcgagaacagcagccctaagtgtatagaagtgggggtaatttggcaataattagtaaagactaattcggtggcagagcaaacgcaaactagggcactgcagtagtttggagagacctgtagaaataagaagcaactttattgagaatcttctatctactgcgctagacactataccatctgcctcaattttcacagttctggcaagtgggatctttgttccctttatacaagatttacaatttgggggagaggcgggtcacccagtcccgcggctaggaacgcgcctctttcctctcccatcacgctgcaaggcttggagtcacttccggctgcaggtcccggaacaaatccgaccccagaagtggggacttctggccctcacctccccatttgaatgtaatgtttacagtgatccagacctggggatgcttgcttcccgacgtgtcctgggatcgcgcttctgaaaaagctcacctcacaacgcctcctccggacctaaatcgcgcaccagtgagtcgagtcctccaggggctagagaagcccgactttctttccggccttgagggacccgggctcaccaagaaaccagccgccctcctctctatggttttggagccggcggagagcgcgcaagggttggcgggactgcgagtttccggtctgggctttggcgggtctggtttgaagctctcctgtttgacgaaagtatgtctcaggaaggtgcggtcccagctagcgcggttcccctggaagaattaagtagctggccagaggagctatgccgccgggaactgccgtccgtcctgccccgactcctcatatccttccttggttgtcacttctacctagagaagggtgtgggcgggtcgcgaacctttctcttctgtcccttcagacccaccgccaggctgggttatattaccgcggcctgaaccccctcttttctttgtcagtgagtgggatgaaaagtgagggactggaggggaagcgacaaccgtggtagatttaagtaaggctttggccctggaaagcctcgcggacgtgttctgacccaaggttttagcagtggatgtggcgttttcttccattccttctttcagtttttctgtactcgttgcttgcaattaagtgtaaatacttttgctagtggataatgggggaggcaaggactgagacctgcggtatgacgatagctctggctcttaatagtttgaggtaaagcgagatactctgagcttttgtctcccgtaaaaagggtggtgaatatgaataagggctttcttagcgttataagaattaaagggcatagttctgtggtgtgaaatctttaaaagatgttcagtaaataaaaatgattttcctccttcccctctcagacctctttttcttctttctttctttttttttgacaagttctcactcctctcacccaggctggagtctttctgaaagagttcttccgcttgttgttggctttcaactgttggatttgaggcgcttagcgccttcttcgtccgggtgcagcacattcttgattggtctcatgcctttgtggttgtaaatgtgcctggaatcctagcctttcatggtaaaccatatgtatatgtatctttttcacaacatttgagcccagctttatacaattacactcaaaagaaaaaaagtaaccttcacttgagagaatctcaatactgcacaaatattgtgcagctaaagccctatgtaatcacatagaagtcattcacctaggcattagcaaaatctcagaaggtgccaaagcccccttttttagtttttgtgtaggtacagaactgccgtcttcaaggagtttcaacttgaaaacaaatagccaccctcaaaacattcaaaaacacttaaactgcgtgcataatgtgtgtgagacatggtgttaggctttgggagaacagagacacggaacgtgattcctcttcttccccacaagcttatagagagacttcattaagttgaaagtcaacattcccacctagctttgcacttcaaacgacatattcaaaaaagcccaaacttcctctagttttcttcatctgagtaaatggtttcacaaactgaaaccttgaatcctctctgtctcacacacccgatcagtaagttctattgtttctgattccaaactatgtcttgaatcaatccgtttatctccatcctcattgctaccactctgattccaaacccttatcacctctcacttggagtattaatagtttccttgtttctactcataattcattattccaaaaaagttaagaggggaaaaacatagatctcgtcatttccctttttaaaccactttaccttcaaggttccaggtgatctaagccttgcccttctctcatacctagttaattaactacactctgttcatgaatacattaggctcacctacctcaagatctttttgctcagcctgatttgttctctcagccttttgcatatttcatgtttatgtcttggcccaaatgtcacttccttagaggggctttttcagagccttcaatcttaggcagttcccccaaacgcagtcttacacttgtatcacattggcctgttcagttttctaaaaagcacattaccattaaaagaaatgctcttgtttgctttgtatattttccacttctacacattatgttgcaaagttcataaaggcaggatgttgattttcttcacagcgttaccctcagcacctagaacagtgcctgacacatagtaagcattcattaaagggctaaaaatatttcatgttttaaaaatacttgggagtctaattagacaatactttttttcagcttaatggtagtattttagcttcactattttaacaaatgaaaaatttgcaataaatctacaatgccattaccccccaaaatctttttcatgttttgcattttacgtattattttccaggccttacctgcatgtctgcataatcataactgactaattttggaacagctggtaattatttgagctttactgaaattttttcatgaggccaattctaccctactgaactcaaatttgagttaatgatgacctcattttgattgctgctgtaaaaaataagatttcggaagaggaatgaattcttgtattactgtggtaggactatgggtttttttttgtttgtttgtttgttttgagacggagtctcaccctgtcacccaggctggagtgcagtggtgcgatctcagctcacagcagccaggttcaagtgattctccttcctcagcctcccgagtagctgagattacaggcacgtgccaccatgcccggctaattttttgtatctttagtagagatggtttcaccatgttggccaggctggtctcgaactcctgacctcgtgatccgcctgcctcagcctcccaaagtgctgggactacaggcgtgagccaccgtgcccggccgggttattcatttttcttattaacattctttgatgattcttatggtgttgttacagtaaaacatttctaacaattattctaacaattattcttgatggtgtatatgaagaatttattgtcgtgtatttgtaagctgctatgtgcagaagaatttcagtcaaataaagttggtaagataggtatgtaagtaatatgaaaaaagatagaaggtgatgagtgacttaggtataaattaagtacaatagaaatgttgaggaaagaaaaatttcttgtaatagaaatcggaagtacaaactgggcatggtggtgtgcatctctaatcccagctccttgagaggctggtatgggaggatcactttagcccaggagcttgaggctgcagtgaggtgtgatcatgtcaccgcactccatcctgggtgacagcaagaccgtctctctttttttttttttttgagacggagtctcgcctatgctggagtgcaatggcgcgatcttggctcactgcaacctctgcctcccagtttcaagtgattctcctgcctcagcctcctgagcagctgggattacaggtgtgcgccaccatgcccagctaattattttgtattttaagtagagacgggttctcaccatactggccaggctggtcttcaactcctgacctcttgttcgcccatctaggtctcccaaagtgctgggattacaggtgtgagccaccccacttggccccgagcgagaccctctctctaaaaaaaaataaataaataaatcataaacctgtggattattgtagcattgtttctcatctgtcaaaaatatttcatgactatgcatagtttgaaaaggcaagtttgtccctgggcaattttcaaaatatttctttaatgtgttttcacaatactgtttacctaataaatcttaagtttttaaaagcaaaattaagccagtaatttgagtccaattccaatctcttatgagtcattgcttaaatttcaaaagggttttattttttttttaggtttgttctgagtaatgaataccctattactatgatactagtatcttccttaattatcctactcattgtctcaacattctgacagttggattgagcatattcgtaagtaaaattgttttaactgtatgatgtactttgatgttaaggtccgagtccccacatacctcggtagatgtgttcttacagttttgtattcccttgaaatgtaactgttctctatgttacagcctttataaccttcagttacttgaaatgaacaaattcattcaaattccagcacttaaaagttttaaattacattttggataaataccaaagtgttttgttgatgatgtatgtataaacaaattgtaaatattaaacgttagttgttacgattagacctatataaaacatgatatgcagtctactgaatagctatcagcctctaacatgtttagtgtcatttagaaaatgctttctaaattgccaaaagctgattgtctaggtgataacaaatttaccatttggaggaagttgactttctcattttcatgtcttcatcagtcttacttgatgagattcattcttctagtcagaagagagtttagactgctcagtttactcatattttgagttagcttttctatttagagttcacttggttgtggaatattcatttataatttgaatctacgttgtgtaatgggacctaatttttttttcctttgtttttgttggagtctcgttttgtcacccaggttggagtgcagtggcgtgatctttgctcactgcaacctccaccttccaggttcaggtgattctcctgcctcagtctcccaagtagctgggattacaggcatgcttcaccacgcctggctaatttttgtatttttagtagagatggggtttcaccatgttggccaggctggtctcaaaactcctgagctcaagtgatcctcctgccttggcctccataagtgctgggattacaggcgtgagccgctgagcctggccccagagtttgttttgttttgttttcaagacaagatctcactctattgcccaggctggagagcagtagtgcgatcatagctcactgcagcctgaactcctgggttcaagctattctcctgcctccatcttctaaagtgctgtgattacaggtctgagccatgatgcttggcctgtgtttttgtttgtttgttttgggggacagggtcttgctttgtcaccaaaactggagtgtagtggtgcgaacatagctagctcactgcagcctccatctcccacgctcaagcaatcctctcacctcagccttccaagtagctgagaccgcaggtgcgtgctaccatgcgtggctaattttctatttatatatttattttttggtagacatgaggtcttgtcatgtttcccaggtggtctttaactcctgggctcagacagtcctcccgcctcagccacccaaagtgttgggattacaggcgtgagccaccatgcgtggcataattttttttaagtaaattatttttttatcttgagtatagaagtgattcatgttcattgtggaaaatatgaaacatatagaaaaacagaaaagattacaaaacatctaatctgaaatggttaagattttgatgagaacagtctcatctcatttccgtatattcctgccagcctatccatcattcttcgtacatgtttatctacattaaaattggtgttatattttggaaactttttgtttaactacattgtgaacatttttcatgttttaaaatgtcattttaatgatggcagatcctattcaatagatgtacacacacctatttaactggtccacaattgttggatatgtaggtcgtttcctttctctctttttttttttttttggctactacttaatagtttctctgtatagaatgtggtattttgaaagtgtatcaagctttagattggtagtattcttgcatttaataaagggcagtggcctttgttgactgacatgacaatatttttataaaatttgttatttgctttacagaaattttgaaaattattgtagaaatgtttttacctcatatgaaccacctgacattggaacagactttcttttcacaagtgttaccaaaggtataatactattacctgaaaatacatgttataaggaatctagcctcagtcttagatgatttattattaattatggctctctttttctaatatatcaaatatattcaaaataaaaataaggagtaagtagatctcatgtgagactataatggtgttagtgtgatcattaggcagttaaaaactgttacaggctgggcacggtggctcatgcctgtaatcccagctctctgagaggctgaggtgggcagatcatctgaggtcaggagttcgagaccacccatggtcaacatgatgaaacctcgtctctactaaaagtacaaaaaattagctggacatggtggcaggtgcctgtaatcccagctacttgggagactgagacaggagaattgcttgagcctgggaggcggaggttgcattgagtcaagatcgtgccattgcactccagcctgggcaataagagcgatgctccgtctcaaaaaaaaaaaaaaaaaaaaaagaacttatattttcagattgtgtggttcctttactaactgaatttaaattatttgtagtcaattttaaatgctcttgtattttaaagccactgtactccagcctgggtgacagagtgaaacccttaattcaaaaaaaaaaaaaaaaaaaagaaaagctggaatattggcaaaatcaagtaactaagagaaaacattaaattcacagaatacattattacattttagatatatatggtatatgttttctctgaaaagcacaagcataccttttttgttttaaatggagggaactaaagatactttggtgccaaaatgaaacattatttgtaattaatctcttattgaaatgggtttctaactttagctttgaatcgtaatctttcaaatttcttgtactcatagtcacttgatgattctctatctgaaatatttcttagaatttgttcttgaccaccagaaaaagattcaactgttacatagatgaaaatggatgttgagtgttaacaggcctatgggaaacagtattttctttagctacattgtattgttgactgtgttgctattcttataatgtttaggtcatttaaattgttagaaagatccaagtattaagatctagggtggctaacttttcacagacaaaaagcttgtttgtaaggtcatttactatacccttaattcaggaaggttagcttgaattgggtcaaaaggaaactggttagaaaataagtgagtagtgaataggcgattcagtgcaaattccttccagaaaatacccttgtaaatgactgtatgaatgtggattcttcaagacagtcaaatttattgtgcgaaagtaatacttttattttttgcatctctaaaacatgaactttgagtgattttttaaaaaaattgatgctattaaatagattcaaaccatagaaatggaaaataaatttctgtttggggcttttggggggattatgttgtaaaaataccttttctctgtattttgtgcttaattaggtacaattgttaagctagatgatagcctgtggatgttactagtgcaaaatcaaattatcgtattgtgttttctctgtaaagttttgtcttgtcttttctagtgatttctcttattcctgtttattacttgatttgtttttacagactgtgaaattattcgatgacatgatgtatgaattaaccagtcaagccagaggactgtcaagccaaaatttggaaatccagaccactctaaggaatattttacaagtaagtcaaatgtattagaaagcaggagagagagggagcttaaagaatgtcaaaatttttatactgatactgattagctatgtattcttatgtaatggcctaatgttggaattaaatttatagaattaaagacgtgaatatagaaacatgaattctgaataataaactcttataagaagagaagtcatcaagctagctgaccctacctgtattttcaaggatatgtgtggaacacctgccatgtgttttgaagtttgtgttagtattctaaatggctagacagttgttccagtatttgtagttctgatagactaaagttctgtgaaaagaggaagagactgtgttttgttcattgctgtatttgtagcacccagcatgctgactaataccttttcagtgcacaaaaaatatattctaagtgaaatttccttccttattcacagacaatggtgcagctcttaggagctctcacaggatgtgttcagcatatctgtgccacacaggaatccatcattttggaaaatattcagagtctcccctcctcagtccttcatataattaaaagcacatttgtgcattgtaaggtgagtaaaggtctaattatactttgaatggtatataatcaatgtgcataggggctgagtaaaataatgtttgtataagattttacattttagtctatattattgaaataaacttttccatagaataaagaacatgtaagtaaataattgttgcaaaaaaagtggttttaaggaagtcattaaaagtggctttttggggttttttagttttatcttatttcccctctataaagaaagaagttttaagaatttgtgttgagacagacacagggatcctgaaatagttatgtcatgttgcattgaccaatattcaattaccattatgattagatgtcagaacttccttttataaaggaaagttaatccttatttagtccatctctacatgccagaggtagccttgaggcacaaaagcttgcctagaatttatgggtcacagacagttttaatattgctatttgttgggcgaatgaaaatcactagttaattaatacctctctttgctgataggatgctaaaaatgtcacgcacctggcctaatgttacccttttttagttctgtatttgcaagatcatggaagtcagaaataatattttatacatgcttgcatctcttgaagcacactatatttaatggatgttcactaaacaatgaatgaatatgtgattcagtaaatttatgatctctaatagtatgaattaaagtaaatttggctcttgagctttgatttgttttttctctcatttttatttatccgtaatcagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaataggtgagtgaagaaaactttctgcttagtatatggtgactataaatcatgtatcaattaaaattgtctctaatgattcatgttattttcttactaattatgcattaaaattgatttaaatcttaccaaataaatttttaatcttgaaatttggaatttgtaaaatttattttgggtaccttaacctagatttgcgtatttagttactgtaatttctccacaatgattaacttatataactttataatctctgaggttgtccatattcagagacaataactttcacatttttttaaccataactgatattgagatgcagtttatatttccttccagaatacatataaatacgtgcatatgtgtatgtaaatatgtctattctcatatacatattataatgaaataactcattttacatgtgatgcactttatactagtttatttttattttattttatttttttgagacagagtctcactgtgtagcccaggctggagtgcagtggcacaatctcggctcactgcaacctcgcctcccggactcaagcgattctcctgcctcagcctcatgagtagctgggattataggcgtccgccaccacacctggctaatttttgtatttttagtagagacagggtttcaccgtgttggccaggctggtcttgaactcctgacctcaggtaatccacctgcctcagcctcccaaagtgctgggattacaggcatgagccaccgtgcccagccaatactagtttatttttaaagaattgctggtcgtaacacacttcattgattttatcactcattaatggattatgaacaagagtttgaaaaacaatataaaggcaaagtttgcattcaaaactttggtataaagagagtaagttggttttgtgcagtgtatcaggcacctgttgctctgcaacacaccacctcaaaatctatttattcactatttatttattcatgattctgtgagtctgcagtttagggtgggatgtcctgagacaactttctctgatccacctggggcactagctcacccatgtgacttcagtgacttcattcacatctggctgttggcagaggcagaagtacttgagaaagccatgtgcatcatccagcaggttcaccctatctcagatacctgatgccagtggtttcagggtttctaagagtagcaaaagtgtgagcaggtcgctgtgtgctagcacttttcaagtttctgcttgccttaattttattattgtcccccgggccacagcaggtcatagcgtttagcccagagtcattgtagaaaagtgtggattcacaaagggcagtcattgtggccatttttataaataatctaccacagactgagtaaaagccttgcatgaataccatggatattaatttgaattcttcctttttagattttctttccttagcaatttgttttgtcattttggattagaattatatctgtagaatatttcagttataatagggtacaacttttattccactgaacatctttagttttatttaggtcatctggtaggtataaacttcagaagttaatattcaatatttataaaaaccattaacaagtgtgacacttaaatagtttaaataattcttttgacacaactgtttccaagttgtgttacgtattttaattcaatcaaatgttgaaattgttcagtagatagttttaattataggagaaactcacccccatgacatttggatgtcttaaaagttctgttatctttctttgcagttattcattctttattggatatctgctctgttatttccagtatggaccatgcatttcatgccaatacttggaagtttataattaagtaagtttgtttgttattttttactttttagaaaatgttttccatattccccaatcttaattattcatgattctttagattgcatttaaaacattttgtgtgaatttaatgttcactgacactgctgtctgataatccagatattctacatgtagctctcaagccaaattggacttctttaccctgtggcctctaaaattaaaaaaaatgttcttcctagttagctagtacttcagaaataatgggccatgggccagactagaacttaaccacttttcttctgctactgttgtttaaccagctatcaagtatcctatttctaggattagataaattgataactataattaaaactgaatataatcttttcattaggtacttttaagttgttcacacttaattccatttgtacagtaattttaactttctgaaactgaagcattttaaagggtcaccagggatagtgcctgtagcattcatcagattcttaggggtgagaggagatgtggttgagatgtaaaaatggttaagaatatctactttatacacatacataaaacattaaaggtcagtgtattttcaggtcttaggtacttttcttgtactaccaggacattaagttgccattcagtggttaagagtgttgcctgggagctgtatcacatgtgcttaaatccattcttgaaatcatttactccttctgagcccttgggctatttggttaatttctctgaacgttagtttgctcatctgaaaatggaaataataatagcaacttcttgacagggttatagtgagaattgagttcatcactgtgaaatgcttagaaatgtgcatgacacatagttaatactcaaggaattagccacatcactatcatcatcactgattatcttccactcttaccctcttccagttcattttctgcccagcagaatgatcttttaaaaagtaaatcagatcatgttactctattgcttgaagtctatcccatttgattaagaataacaacctaatcctctgtggatgctgcctccttcaccagcctgtctcatgctgctctccctactcttagttcctcaaacataccaaactctcctgtcccagagtcttttcgtggtttttccatctgcctaggatgcttctctctcctattttgtgtaccttgctaactcctgcttactgtctttcagttctcagcttaagagttatatcttcatgataacattctttgatatccttaccctaagattaagttagattgatatccttaccctaagaataagttagattaggtctctctattgtagcaccttagactctgtcatttgacaaatcacagccctaattaattattcttaaaattatttaacattctctctcatgctagaccacaagtttcatgcaggtaaggcggagattgtgtccatttgtttgacccctttgtctccagggcctggtagaatgcctcatacatagtaagaattcaattaatattttacacagagaaaaaattagcaacttatttaaacaaatataactgcttcagaggtaaactgggcacatcttagttatattatgtgatatatgatgctttttgattgtttttttaaatgttctacaaggtagatattgttagaggtcctaagttacttgatgtgttacttgtggtgattgtattcttttctttttattcatttaggcagagccttaagcaccagtccataataaaaagccagttgaaacacaaagatataattactagcttgtgtgaagacattcttttctccttccattcttgtttacagttagctgagcagatgacacagtcagatgcacaggtaaaatttgggctaatagcattttaaacagcaactcttattttctttggcagttagtaaatctcatttgaatgtctgggtcagtctatttaagaggattttaatttatttcatttgggtgtttttttttgatctgtgggattatttatatcccataattacttttcacccagagcattgtattagattcctaactgctgtcattgcctctggggtctgcctggctccctctttgcttggtaactggttggtcacagcattcttctcagaatcctttcattcttttctgcatgagaacaaaaattcttttgttcatatttgtataagatctgatatagctgcaatcaatcttgcattttttcttcaccaacgcattgcgacctttagggatacaagtatgtttgtgcatgtatatgtatgtatcagtcttttaaatttgatatagtcatacatttgtttttattttgaaaagttagagtgttgaattggtatcccatttatgaaacattatattctaaaaatttgtagtacgattattgggaattataactcattttcctgtaacactgttatacatagtaccttttgctttcagactagccctcaattttatttaactatagtagtcctaaattataagattaatagtactcaggacctaacagttatatgtcatttgttttttttttttttgagatggcgtctcactctgtcacccaagctggagtgcagtggtatgaccttggctcactgcagcctctgcctcacgggttcaagggatcgttctgccttagcctcctgagtagctgggattataggcgcctgccaccacgcctggctaatttttttagtagagacggggtttcgccatgttggccaggctggtctcgaactcctgacctcaggtggtccacccgccttggcctcccaaagtgctgggattacaggtgtgagccaccgcgcccagcctatatgtaataattttaatgggaccatgaattgaatatttcttccttgaatagcaatgacatagccccttctattgtacatctgcaagctgatacagggaattcctttgtacctgcgctcttccctgccagtcagctatgggggtgaaagtgtaggggttcatccaagtcctaaaactggtagcaactcctagggcagggctgatctggaaggacagaccctaggggagggtggaactttaaaaagaagttctgaaggtagtaagaaggaaatgaggagtagtgttaggaaggggctaacttttttcttcttgcttctcttctttatctcacctgcccctccccttgtatcccttcttcctttttccctttccttttttgtcctcacttcattcgtgcatcctttctgattcctcttaccttgctaaaaggagaagtttgtttgggtatcctatatcaatggcaggaaggttgttttcttctttacctttatcctatagattcatattctcaacaccaacctcctcctttttcagtttccttcttgcttctcttgacaccacagagtttgcagctagtacttggagaggaaaattaaacagagatacttggaccaagagtaagatgaagaaagtctaaacaacagtatagtctatagtggcaagagagagtatgggggctgcttagccagggtggctgtacataaagtatatcttcagtttatataaactgcttatagatggaaatcagaaaatttaaattctcttaactgtccaagaaaattctcattttttcaaatttgggactgataaatgtgaccagttctgcttactgtccattgcctgaaatggagctttgaggtggactgtataatttcttcaatcttaactccaaattctgatcagcgacgccctctgctgttcactattaatatttatttaccaatcaaagtaaagtattgaagttttcctggcagttttcactttgtgttttagtccatttaggctgctataacaaaatcccttaaactgggtaagggattataaatattagaaatttatctctcacagttctggaagctgggaagcccaatatcaaggcaccagtagatttggtgtctaacgagggtgtgccgtctgcttcaaaaatggccccttgttgctgcatcctcacttagtgcaaggggcaagacagctcccttcaacctcttttataagggcacttatgtcattcatgagggcagagccctcatgacttaatcacttccccaaaggccccacctcttaatagtatcacattgggtgttaggtgtctgggaggacaccaatcttcaagccatatcatctcacttggaaaaaagtcaaaataaaaccagtagatttaattaatattacactatttatagaagcatgtgatgtatcattccttgtattaatttcctggggttgccgtaacaagttaccacaaactaggtggcttaaaacaatagaattttattctctcacatttctagaggcagaagttcacagtgtgtcaatagggccatgttctctggaaggctttaggggagaatatatttcatatctttctcttagcttctcggtgtcactggcaatccttagcttactttggctttctgtgtcttcacatcatctttttataagaacaccagtgatagtgattaagggcataccttactttaatatgacctcatcttaactaattatgtcttcaataaccctatttccaaataaggccacattctgaagtattgggagttagaacttaaagctttttgggagggacacagttcaacccataacaacccctaaaatcgatatttattctcaattaagtcttgaaattggtttcaaaaagagaatattctattagagtttttaatgtatagttttaacatatagttctttagcccccaattttttttttttttttttttttttttttttttttttgagacggagtctcgctctgtcgcccaggccggactgcggactgcagtggcgcaatctcggctcactgcaagctccgcttcccgggttcacgccattcccctgcctcagcctcccgagtagctgggactacaggcgcctgccaccgcgcccggctaatttttttgtatttttagtagagacggggtttcaccttgttagccaggatggtctcgatctcctgacctcatgatccacccgcctcggcctcccaaagtgctgggattacaggcgtgagccaccgcgcccggcctgcccccaattatttagtttttctataaacagggaaatttatttgtgtggcccttagaactaatttaatttccactctaattcctacttatgtttatataatgcttttagaaatttgtattattcagaaaataaacatatactattgtatctgttgcctacacttagattttattgcctgctatatttaaattttattagtattttaattgttttattaaagaaagaatgtgcctgtaatctcagcacttttgagaggccaaggcagaaggattgcttgagcccaggagtttgagaccagactgagcaacacagggagacccccatctctacaaaaaataaaaaaattctccaggcctcatggcacatacctgtagttctagttacttgggagactggggtgggaggatgcattgagcccaggagattgaggctgcagtgagccatgatcaggccactgtactccagcttggacaacagagtgagagcttgtctagatagatagatagatagataatctaaatagataatagacagattatctaaatagataatagacagattatctaaatagataatagacagattatctaaatagataatagacagattatctaaatagataatagacagattatctaaatagataatagacagattatctatctaaatagataatagattatctaaatagataatagatagatagattagatagatagatagatagatagagcttggacaacagagtgagagcctgtctagatagatagaaacaaagaaagaaagaaagaatggtgctcatattttaaagcattgaaaaatggtcttccttgcttatattacccacaccttctttgttggcattaagatgcaaactttgttttaaacagttgagtaaatcaaagatgggactgttaagttatttgtgttatttacctgctttttgaaaatgtaaaaataaaactctaggtttaattagtagtatgctatttagtaatgaagtaaagctagaggcttcgaacaaatcttgtgtaatttcctcttgaatgagagagaaaatttaaagtaagcaaacaaataagttgtgtgtcaccactcattcagtcatttaacaagtatttccagagtacttattctgtgccaggaaatgttgtaggtgccctcaacaacttagagtctagcctgagacacaagtaagtaggtaattattatagaatggtatgatctttggaggactgggtattggctggctcatgggagtacaagataggtacccagtgatgaagtcaggaaaggtttcttatggtgatatgatgacgtctatgctgattataaggtcagtgtagaataaactttgtgcttttaaatttgcatagcactgtattagagagttcatcttcaaaataatcgaaaaggctgagtgtggtgacccatggctgtaatcccagcactttgggaggccgaggtgggcagattgcttgagctaggagttcgagaccaggctggccaacatggtgaaaccccgtctctactaaaaatacaaaaattagccaggagtgatggtgcgcacctgtaatgccagctacttgggaggctgaggcaggaggatcacttgaacccaggaggtggaggttgaagtaagccgaggtcatgccactgcactccagcctgggcaacagagtgagactccatctcaaaaaaaaaaaaaatgatcaaagaaaggtgaattttcatctaccctatttctgctgaggaaaatggactattttcaaatatttttaataagggtcaaaatgagggatcgccaccatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgcctccatctggatcctgtcctttatcctggccattcctgaagcgattggcttcgtcatggtaccctttgaatataggggtggacagcataaaacctgtatgctcaatgccacatcaaaattcatggagttctaccaagatgtaaaggactggtggctcttcgggttctatttctgtatgcccttggtgtgcactgcgatcttctacaccctcatgactggtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcct

SEQ ID NO: 3010 - DNA, 2936 bp; single-stranded, linear
ccggggctgcbgcbbcctcbtcbgctcttgcctggbgtggctcbgcctgggcctgcbgggccbccbggbgbbtggcbgcbbggbtggcgbgggtcctcbtggctggggtcbcbgbtcctctbgctbggcbgggtgbccbgbgbgggcgggtcctcbtggctgggggcctgggcctgcbgggccgctcttgcctggbgtggctcgcccbgbgtcttccctggtgctcagcctccaaaggagccagcctctccccagttcctgaaatcctgagtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactttttataagcattcttttaataaaggaaaattgcttttgaagtatctgcagtggtaaaaagattctatatctgctgtttgatgaatgcagcacccactagccacatagtgctcgtgagcacttgcaatgcggctagggtgatttcaattaacctaaaagagaacagccacagggagcatgtggctgccatattggatggtgctgctttgagaacaaaatgagagaaatgaagcctctatttaccttggttggcggaacacattgaagggactctgtattgataccaggcttcaaactttgggaagtgtactggccaacttaaacacatccacaggagaatgaagaggtttgggaagggaccagaaaccaggcattgaggacaatgagaagagtttttcaaaagtggaattactgcaaaaagtggaaaaatagcctttggatggaagttactgatgagacaatttccatcggtgtgaaagccatctttccaacagagatctgcaacatgagaatgtactgtctcctagggtagcgatggcctcttgtattagtccgctcaggctaccagatttatcgtttaaactgcccataaacagaccaggcagtttaaacaacagaaatttatttcctcgcagtcctggaggcaggaagtctgcgatcaaggtggaagcagggttggcttcttctcaggtgtctgtccttggctggtagatgaccgccgcctccctgggtcctcacatggtctttcctctgtgtgtgtctgtcccaatctcttcttataaggatgcaagtcttatggatcagagcacaccccaatgaccgtgtttaacttgaatcacctctttaaagtttctctctccaaatacaatcacctcctgaggcactgttagggcttcgacacaggaattcttttcctaggggattcagttcagtccaaaacgcctaccagtggagacttgcaacatggcggcctgctggtccctcgccaggaatatcacaggcgactgttccctgttgcatggaatagaaggctattccagagtactgtctctatttatcagatctgggatactgggagaagggcaaaataaagtccaagtagaaaaaaaaactatgaaagttttagagagtaaccataatttcagcccgatgtgaaacgatcctagatttcagctgaaatagtgatgtgggaagtgagggggccgggattcaaggcagagggaacagcgtaactgaaggcatggaaggagggaagtgtaggctgtgtttgaagagtggcagctgcttccacatttctaaaacacaggatgtgattttggggtgtgttgagacaaggcagaaaacttgtttggaaaaataacttgaattccctgcacatttaaaatctctcagcagaagaaaaccccactcagaaccccactgttcattccttggcttgtatttggscacagctggcatagccccagactgagtaagctcttcagacacctcatttcatgagtagccccaaagatcaatcatgggccaatttcttggaagagaagactctccggtgttttgcagttatttgttctgctttcgcgagatgttctcaaatcgttgcagctacaagccatgagtctgaagtgtttgtgttccctccttacaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgagagtgaccagaagaaatgacgcagaagtgaaatgaactttttataagcattcttttaataaaggaaaattgcttttgaagtatacctcctttgggccaaaatgaatcttgtgtctcaattggaagaggtaaagaagtagggggttagggtgcatgggttggaacgtgagacaggtcgaaccacaaagcctgcctggaaaaggggagtgacgtcctaggcttcagtgatgtcacctccactttgtttgatccacaaaccaacaggtgactgattttggtcagctcagcctccaaaggagccagcctctccccagttcctgaaatcctgagtgttgcctgccagtcgccatgagaacttcctaccttctgctgtttactctctgcttacttttgtctgagatggcctcaggtggtaactttctcacaggccttggccacagatctgatcattacaattgcgtcagcagtggagggcaatgtctctattctgcctgcccgatctttaccaaaattcaaggcacctgttacagagggaaggccaagtgctgcaagtgagctgggagtgaccagaagaaatgacgcagaagtgaaatgaactt

SEQ ID NO: 3011 - DNA, 9454 bp; single-stranded, linear
atcctttaagtcaatggactttgcatcagtcacaccatcttttgttactttggacttccccagctatgttcaataattactgttcttcccttgggccccattgtaatggctacagcctcgacaaaaagtctacactttgaagcattaaggctcggacatcagcaccaaattttacatctttaccatcacttcaagtgaggtgaggagccagtagcctggacactggtctcatctggtgaaagactgtgggtaatggaagcatttctgtggggtgctggcaggacatgtgcatggcgaggcaggtcatcagcagcaagtgagagctgcctcttactttctaaaggtgacatagcaaatatacaaaaaaaaataaataaattattaatttaggtagagcacataaaggctttatttcatattccatttctctgtatgctttcttcaccaggaagaaatagttttagtgtcaggaatgaatgagtctgcccctcaattccagcctgctcaacacacaaggaaacaaagccctgacaatcagagtgactccctggtgactaagctcccagtcctggatgcatatttgtttagcagttctgacagcatttgacccagccctctctctgcatatcccatcagaaccttcttttttttttttttctttgagactgagtcttgctctgtcggaagcgactcctgtgcctcagcctcccaaatacctggaattataggcgtaagccatcatgcctggctaatttttgtatttttcatggagatggggttttgccatgttggtcaaattggtctcacactcctgacctcatgtgatccacctgcctcagcctcccaaactgctgggatgacaggtgtaagccaccatgctaggctcagaaatttccttttataaaaatgtcattaaggatcttggctgcacaatatcgttaccagcttcctttaaatccacttctggcctgccaggaatcaggttcttcagaacctgacattttaaatgaagaggtcaggcagttcatgaggaaagcctcattgtccccatgtctctgtcactgctgcacccctgagacatcacagacatggacactggggcctgcttgtttctcaaactgcccttagatcgaaagagggaggaaccaggatgaatgccactcattttcccaagaaaggccctctcctgagtgcccgggatggggctctgtccattgcctggggccgccaattgctactctgggttacggaggaaggacagggtcctgagagacaccagagacctcacacagccctgaaaacatggggctccttcataagtgtttcccatcaccaacagggagaccacgtggaggccttgcagccccactcggtgcttctccaccaaatcccaagggcagtgacgctgacgtctgtggaaagcagagaaagccctggctcccaaagccctgaagtccctgtggagctgacattccctgagtgacggtgtgaatggaaggaactcaagtgcgggtggtaggccacctcctggcccaggcctgggtgaactctgaggggacacatgtagtcacaatcccatcctcccattctccttctcagaggaaggaagtgggcatccatctgcctcatctctctcccgtggggaagatggggagtttcaggggaactttcacataaatttcaccagctcagatctcctgtgaggatggggcccaccatgctcccggtgctgccagaggccctgagcccctcccagggtccctgggtttgagccagccctgtatcatccccaggagctgaatgtcagagcaatggatagaattagatggaaagagctctcaatttgacctgagactgtccccagatactcaggaaaaacaggacgtcgcacagagtgggcagcaggtgagtggcaggttataggtcctgagtttgagtttgttctcacgtgagacagacccagcccctcactccattcacacactgggttttaaatggtgcaagataggagcaattttctggtcccaagagcaggaggaagggattttctggggtttcctgagtccagatttgcataagatctcctgagtgtgcattgttctttgaggaccattctctgactcaccaggtaagtggctgaattctaacctctgtaatgagcattgcacccaataccagttctgaactctacctggtgaccagggaccaggacctttataaggtggaaggcttgatgtcctccccagactcagctcctggtgaagctcccagccatcagccatgagggtcttgtatctcctcttctcgttcctcttcatattcctgatgcctcttccaggtgagatgggccagggaaataggagggttggccaaatggaagaatggcgtagaagttctctgtctcctctcattcccctccacctatctctccctcatccctctctctccttcctctctctgtgtgtcccctccatccttttctcctgcttctctctcttcttccctctctctcttttttctgtctttctttttcctctctccctagagcatgtctttctttctttctctttcctttcttctacccacacttttagactgaatgccctatttaattgaacaaagcattgcttccttcaatagaaaaggagtttgagaacccaatggacacctcactcgttcttctaagccaatatgaaggagcccagtagcttgtaaatatcatctcttcactgctttccatgctacaactgctgagactatggttgaaacctgttaggtgactttttaaataaaaggcagaaattttgattttatctaaagaaagtagtatagaatgtcattttctaaatttttatatttaaagggtagatactgcaacctagagaattccagataatcttaaggcccagcctatactgtgagaactactgcagcaagacactctgcctccaggacttttctgatcagaggccctgagaacagtccctgccactaggccactgcaggttcacaggacagggtacagcccattgaaacctacttttaaacctggatgcctaaccttcattttctccttgatattatgaaaataaaataaaaaccatgaaaggataaaagagggagagtggaagggaaggatggagaaagggaaaaagaaaatttgagagtaaatcctaaaacaattaatctaatagatatcatcttgtgaaatcctcattttaccaatcttatttatgagtcctgggttttgtgagaacaatggggttctgagaggcaccagagacctcatgttttccaaaacctagaacagtataatgaaggaaggcggggaggcagggaggcagggaggcagggaggcagggaggcgggcaggtggggagggagggacggaaggagggagggagggagggagggagggagggagggataaaaaaagaagaatgaggttgaaaccaggacttagatattagaaacaagccattacaaaatttatttctatggttaattgtggttttcaactgtaagttacttggtgttaatttcctattaaacaatttcagtaagttgcatctttttatcccatctcaggtcaaatacttaacagactaaatgatttgaaaaagcaaaagtttactggcttgtgtgtgttaaaatggaggtatggtggctttgatattatcttcttgtggtggagctgaattcacaagagatcgttgctgagctcctaccagaccccacctggaggccccagtcactcaggagagatcagggtctttcacaatcaggttctacaaaaataaacatccccccaaccacagcagtgccagtttccatgtcagaaacttagatccaaatgactgactcgcgtctcattatcatgatggaaaagcccaggcttgagaaagaagcccgctgcggatttactcaaggcgatactgacacagggtttgtgtttttccaacatgagttttgagttcttacacgctgtttgctctttttgtgtgttttttccctgttaggtgtttttggtggtataggcgatcctgttacctgccttaagagtggagccatatgtcatccagtcttttgccctagaaggtataaacaaattggcacctgtggtctccctggaacaaaatgctgcaaaaagccatgaggaggccaagaagctgctgtggctgatgcggattcagaaagggctccctcatcagagacgtgcgacatgtaaaccaaattaaactatggtgtccaaagatacgcaatctttatcctagtaattgtggtcattgggtgatgttggtttgggcaggccatctctaatatccttgaaacacctttttctgctctccaggaaggggtcagggctgccacagcggggcttggagtgctttccagggtcacaggcatctgtattctttggattccttgaccttccccatttattcccggcattttcctaaaacgtgtgctttgctcctcctgcatcctccccttgcatgccctcacctaccccacatcttccctaaaaaaagcaagcccaactcaaagaccagttccctcatggaatcatagtggatctgccaagggaggggatgcccagtcctctgttcttcacaagactcccttcttctggctaaggtttcttatgcaattatgaattcacatttctcaccttttgatgtattaagaaagtatggagaaatatatcctctatcaaattttcatgccttcaataatttctaattcatcagtcagtgtttttccatcctttactgtgatgatgccctttcttccaaactttttcattgcatcagagatgatgttaccaatttctttgtctccatttgcagaaattgtagcaacctgtgcaatttcttcaggtttggtcacaggtttagactgctttttaagttcagcaattacagcatcaacagctaacatcacacctctcttgatttccactggattagcacctttgctaaccttctggaaggcttatttggaaatagagcataccagtacagcagcagtgatagtgccatcccccagtctctccatttgtgttattggcaacatcttggacaagtttagctccaatgcttttatatttatcctttaagtcaattgactttgcatcagtcacaccatcttttgttactttgggacttccccagctatgttcaataattactgttcttccctttggccccattgtaatggctacagcatcgacaaaaagtctacactttgaagcattaaggctcagacatcagcaccaaattttacatctttaccatcacttcaagtgaggtgaggagccagtagcctggacactggtctcatctggtgaaagactgtgggtaatggaagcatttctgtggggtggtggcaggacatgtgcatggtgaggcaggtcatcagcagcaagtgagagctgcctcttactttctaaaggtgacatagcaagtatacaaaaaaaaataaaatattaatttaggcagagcacataaaggctttatttcatattccatttctctgtatgctttcttcaccaggaagaaatagttttagtgtcaggaatgaatgagtctgcccctcaattccagcctgctcagcacacaaggaaacaaagccctgacaatcagagtgactccctggtgactaagctccagtcctggatgcatatttgtttagcagttctgacagcatctgacccagccctctctttgcataccccaccagaaccttctttttttttttttttctttgagactgagtcttgctctgtcggaagcgattcccgtgcctcagcctcccaaatacctggaattataggcgtaagccatcatgcctggctaatttttgtatttttcatggagatggggttttgccatgttggtcaaattggtctcacactcctgacctcatgtgatccacctgcctcagcctcccaaagtgctgggatgacaggtgtaagccaccatgctaggctcagaaatttccttttataaaaatgtcattaaggatcttggctgcacaatatcgttaccagcttcctttaaatccacctctggcctgccaggaatcagggttcttcagaacctgacattttaaatgaagaggtcaggcaggtcatgaggaaagcctcattgtccccatgtctctgtcactgctgcacccctgagacatcacagacatggacactggggcctgcttgtttctcaaactgcccttagatcgaaagagggaggaaccaggatgaatgccactcattttcccaagaaaggccctctcctgagtgcccgggatggggctctgtccattgcctggggccgccaattgctactctgggttacggaagaaggacagggtcctgagagacaccagagacctcacacagccctgaaaacatggggctccttcataagtgtttcccatcaccaacagggagaccacgtggaggccttgcagccctactcggtgcttctccaccaaatcccaagggcagtgacgctgacgtctgtggaaagcagagaaagccctggctcccaaagccctgaagtcctgtggagctgacattccctgagtgacggtgtgaatggaaggaactcaagtgcgggtggtaggccacctcctggcccaggcctgggtgaactctgaggggacacatgtagtcacaatcccatcctcccattctccttctcagaggaaggaagtgggcatccatctgcctcatctctctcccgtggggaagatggggagtttcaggggaactttcacataaatttcaccagctcagatctcctgtgaggatggggcccaccatgctcccggtgctgccagaggccctgagcccctccagggtccctgggtttgagccagccctgtatcatccccaggagctgaatgtccgaacaatggatagaattagatggaaagagctctcaatttggcctgagactgtccccagatactcaggaaaaacaggacgtcgcacagagtgggcagcaggtgagtggcaggttataggtcctgagtttgagtttgttctcacgtgagacagacccagcccctcactccattcacacactgggttttaaatggtgcaagataggaggaattttctggtcccaagagcaggaggaagggattttctggggtttcctgagtccagatttgcataagatctcctgagtgtgcattgttctttgaggaccattctctgactcaccaggtaagtggctgaattctaacctctgtaatgagcattgcacccaataccagttctgaactctacctggtgaccagggaccaggacctttataaggtggaaggcttgatgtcctccccagactcagctcctggtgaagctcccagccatcagccatgagggtcttgtatctcctcttctcgttcctcttcatattcctgatgcctcttccaggtgagatgggccagggaaataggagggttggccaaatggaagaatggcgtagaagttctctgtctcctctcattcccctccacctatctctccctcatccctctctctccttcctctctctgtgtgtcccctccatccttttctcctgcttctctctcttcttccctctctctctttttttctgtctttctttttcctctctccctagagcatgtctttctttctttctctttcctttcttctacccacacttttagactgagtagactgaatgccctatttaattgaaccaagcattgcttccttcaatagaaaaggagtttgagaacccaatggacaactcactcgttcttctaagccaatatgaaggagcccagtagtttgtaaatatcatctcttcactgctttccatgctacaactgctgagactatggttgaaacctgttaggtgactttttaaataaaaggcagaaattttgattttatctaaagaaagtagtatagaatgtcattttctaaatttttatatttaaagagtagatactgcaacctagagaattccagataatcttaaggcccagcctatactgtgagaactactgcagcagacactctgcccccaggacttttctgatcagaggccctgagaacagtccctgccactaggccactgcaggttcacaggacagggacagcccattgaaaccaacttttaaacctggatgcctaaccttcattttctccttgatattatgaaaataaaataaaaaccatgaaaggataaaagagggagagtggaagggaaggatggagaaagggaaaaagaaaatttgagagtaaatcctaaaacaattaatctaatagatatcatcttgtgaaatcctcattttaccaatcttatttatgagtcctgggttttgtgagaacaatggggttctgagaggcaccagagacctcatattttccaaaacctagaacagtataatgaaggaaggagggaaggagggagggagggagggaaggagggaaggagggagggagggagggaaacaaaaagaagaatgaggttgaaaccaggacttagatattagaaacaagccattacaaaatttatttctatggttaattgtggttttcaactgtaagttacttggtgttaatttcctattaaacaatttcagtaagttgcatcttttttatcccatctcagatcaaatacttaacagactaaatgatttgaaaaagcaaaagtttactggcttgtgtgtgttaaaatggaggtatggtggctttgatattatcttcttgtggtggagctgaattcacaagagatcgttgctgagctcctgccagaccccacctggaggccccagtcactcaggagagatcagggtctttcacaatcaggttctacaaaaataaacatcccccaaaccacagcagtgccagtttccatgtcagaaacttagatccaaatgactgactcgcgtctcattatcatgatggaaaagcccaggcttgagaaagaagcccgctgcggatttactcaaggcgatactgacacagggtttgtgtttttccaacatgagttttgagttcttacacgctgtttgctctttttgtgtgttttttccctgttaggtgtttttggtggtataggcgatcctgttacctgccttaagagtggagccatatgtcatccagtcttttgccctagaaggtataaacaaattggcacctgtggtctccctggaacaaaatgctgcaaaaagccatgaggaggccaagaagctgctgtggctgatgcggattcagaaagggctccctcatcagagacgtgcgacatgtaaaccaaattaaactatggtgtccaaagatacgcaatctttatcctagtaattgtggtcattgggtgatgttggtttgggcaggccatctctaatatccttgaaacacctttttctgctctccaggaaggggtcagggctgccacagcggggcttggagtgc

SEQ ID NO: 3012 - DNA, 8365 bp; single-stranded, linear
atcctttaagtcaatggactttgcatcagtcacaccatcttttgttactttggacttccccagctatgttcaataattactgttcttcccttgggccccattgtaatggctacagcctcgacaaaaagtctacactttgaagcattaaggctcggacatcagcaccaaattttacatctttaccatcacttcaagtgaggtgaggagccagtagcctggacactggtctcatctggtgaaagactgtgggtaatggaagcatttctgtggggtgctggcaggacatgtgcatggcgaggcaggtcatcagcagcaagtgagagctgcctcttactttctaaaggtgacatagcaaatatacaaaaaaaaataaataaattattaatttaggtagagcacataaaggctttatttcatattccatttctctgtatgctttcttcaccaggaagaaatagttttagtgtcaggaatgaatgagtctgcccctcaattccagcctgctcaacacacaaggaaacaaagccctgacaatcagagtgactccctggtgactaagctcccagtcctggatgcatatttgtttagcagttctgacagcatttgacccagccctctctctgcatatcccatcagaaccttcttttttttttttttctttgagactgagtcttgctctgtcggaagcgactcctgtgcctcagcctcccaaatacctggaattataggcgtaagccatcatgcctggctaatttttgtatttttcatggagatggggttttgccatgttggtcaaattggtctcacactcctgacctcatgtgatccacctgcctcagcctcccaaactgctgggatgacaggtgtaagccaccatgctaggctcagaaatttccttttataaaaatgtcattaaggatcttggctgcacaatatcgttaccagcttcctttaaatccacttctggcctgccaggaatcaggttcttcagaacctgacattttaaatgaagaggtcaggcagttcatgaggaaagcctcattgtccccatgtctctgtcactgctgcacccctgagacatcacagacatggacactggggcctgcttgtttctcaaactgcccttagatcgaaagagggaggaaccaggatgaatgccactcattttcccaagaaaggccctctcctgagtgcccgggatggggctctgtccattgcctggggccgccaattgctactctgggttacggaggaaggacagggtcctgagagacaccagagacctcacacagccctgaaaacatggggctccttcataagtgtttcccatcaccaacagggagaccacgtggaggccttgcagccccactcggtgcttctccaccaaatcccaagggcagtgacgctgacgtctgtggaaagcagagaaagccctggctcccaaagccctgaagtccctgtggagctgacattccctgagtgacggtgtgaatggaaggaactcaagtgcgggtggtaggccacctcctggcccaggcctgggtgaactctgaggggacacatgtagtcacaatcccatcctcccattctccttctcagaggaaggaagtgggcatccatctgcctcatctctctcccgtggggaagatggggagtttcaggggaactttcacataaatttcaccagctcagatctcctgtgaggatggggcccaccatgctcccggtgctgccagaggccctgagcccctcccagggtccctgggtttgagccagccctgtatcatccccaggagctgaatgtcagagcaatggatagaattagatggaaagagctctcaatttgacctgagactgtccccagatactcaggaaaaacaggacgtcgcacagagtgggcagcaggtgagtggcaggttataggtcctgagtttgagtttgttctcacgtgagacagacccagcccctcactccattcacacactgggttttaaatggtgcaagataggagcaattttctggtcccaagagcaggaggaagggattttctggggtttcctgagtccagatttgcataagatctcctgagtgtgcattgttctttgaggaccattctctgactcaccaggtaagtggctgaattctaacctctgtaatgagcattgcacccaataccagttctgaactctacctggtgaccagggaccaggacctttataaggtggaaggcttgatgtcctccccagactcagctcctggtgaagctcccagccatcagccatgagggtcttgtatctcctcttctcgttcctcttcatattcctgatgcctcttccaggtgagatgggccagggaaataggagggttggccaaatggaagaatggcgtagaagttctctgtctcctctcattcccctccacctatctctccctcatccctctctctccttcctctctctgtgtgtcccctccatccttttctcctgcttctctctcttcttccctctctctcttttttctgtctttctttttcctctctccctagagcatgtctttctttctttctctttcctttcttctacccacacttttagactgaatgccctatttaattgaacaaagcattgcttccttcaatagaaaaggagtttgagaacccaatggacacctcactcgttcttctaagccaatatgaaggagcccagtagcttgtaaatatcatctcttcactgctttccatgctacaactgctgagactatggttgaaacctgttaggtgactttttaaataaaaggcagaaattttgattttatctaaagaaagtagtatagaatgtcattttctaaatttttatatttaaagggtagatactgcaacctagagaattccagataatcttaaggcccagcctatactgtgagaactactgcagcaagacactctgcctccaggacttttctgatcagaggccctgagaacagtccctgccactaggccactgcaggttcacaggacagggtacagcccattgaaacctacttttaaacctggatgcctaaccttcattttctccttgatattatgaaaataaaataaaaaccatgaaaggataaaagagggagagtggaagggaaggatggagaaagggaaaaagaaaatttgagagtaaatcctaaaacaattaatctaatagatatcatcttgtgaaatcctcattttaccaatcttatttatgagtcctgggttttgtgagaacaatggggttctgagaggcaccagagacctcatgttttccaaaacctagaacagtataatgaaggaaggcggggaggcagggaggcagggaggcagggaggcagggaggcgggcaggtggggagggagggacggaaggagggagggagggagggagggagggagggagggataaaaaaagaagaatgaggttgaaaccaggacttagatattagaaacaagccattacaaaatttatttctatggttaattgtggttttcaactgtaagttacttggtgttaatttcctattaaacaatttcagtaagttgcatctttttatcccatctcaggtcaaatacttaacagactaaatgatttgaaaaagcaaaagtttactggcttgtgtgtgttaaaatggaggtatggtggctttgatattatcttcttgtggtggagctgaattcacaagagatcgttgctgagctcctaccagaccccacctggaggccccagtcactcaggagagatcagggtctttcacaatcaggttctacaaaaataaacatccccccaaccacagcagtgccagtttccatgtcagaaacttagatccaaatgactgactcgcgtctcattatcatgatggaaaagcccaggcttgagaaagaagcccgctgcggatttactcaaggcgatactgacacagggtttgtgtttttccaacatgagttttgagttcttacacgctgtttgctctttttgtgtgttttttccctgttaggtgtttttggtggtataggcgatcctgttacctgccttaagagtggagccatatgtcatccagtcttttgccctagaaggtataaacaaattggcacctgtggtctccctggaacaaaatgctgcaaaaagccatgaggaggccaagaagctgctgtggctgatgcggattcagaaagggctccctcatcagagacgtgcgacatgtaaaccaaattaaactatggtgtccaaagatacgcaatctttatcctagtaattgtggtcattgggtgatgttggtttgggcaggccatctctaatatccttgaaacacctttttctgctctccaggaaggggtcagggctgccacagcggggcttggagtgctttccagggtcacaggcatctgtattctttggattccttgaccttccccatttattcccggcattttcctaaaacgtgtgctttgctcctcctgcatcctccccttgcatgccctcacctaccccacatcttccctaaaaaaagcaagcccaactcaaagaccagttccctcatggaatcatagtggatctgccaagggaggggatgcccagtcctctgttcttcacaagactcccttcttctggctaaggtttcttatgcaattatgaattccctgtaagccctgttacaggggctgcaccccagatacaacctgacctgtgtccaaggcgggcaactcaacccttagatattgaatgggtcccatggcaccaatgcttaaacaccagcagccctcacaaccacagatcgtgttttaaggatgaggaggtagttctctggatgcacaggcttcaatccaaatgggctcatgacgccgcagcacacacccagtctgcagcctgaagagttggagcattgcattcacagaaagcatccagacatgatcatgggctcagggatacacctgttctccgatgtgtaccagtgaaggatggaaactcctatgcctcccagaaagcaccactcaagcttttgctgaatgcttctctgaaggcccacaaggctgagaggctgtgcaacaccagcagtaaagtgaatgcccagactcccacctcctttcttgggtggccatctggaaaggccactcccaccctgatggctaatgcctcagaccagttcttggcccagatgatcctagacaattgtttaagcttaaactgttcattggccaagcaaacaggtgatagtacctctggggaaccacatgccgcgtgtacatccagatctcaggagaacccaaaaatgtctgttccacatagcaacagaagcccaggtagcactcagtctcacctgggtgttctccaacatcccagctcagccaaatggctttcattagtttttatggttagaccccaggtcctcgggacactgctttagaaacacattccaaatcctcctctgtgtgcaggtggcattcctatcccaatctctttgcagggcgtatactgtgatacgcagccaggctgtcccagaggccttaaatattcccttggtgcaggtagttcagcttagccacagccaatgcatcacagggtcaactgtgttaggagccattgagaatccatagttggttgctgcctgggcctggccagggctgaccaaggtagatgagaggttcctctgtggagttctactttaacctcaccttcccaccaaatttctcaactgtccttgccaccacaattatttaatggacccaacagaaagtaaccccggaaattaggacacctcatcccaaaagacctttaaataggggaagtccacttgtgcacggctgctccttgctatagaagacctgggacagaggactgctgtctgccctctctggtcaccctgcctagctagaggatctgtaagtactacaaaacttaaactttacactgagttttcatcattgaagctatgcctccaatctgacctctgactgtggggccgccccagagggacccagcgggtgaatccctgctaggaacgtctgtccggacctctggtgactgctggggacgatggcttccagctaacttaatagagaaactcaagcagtttccttctaaatacacatgtcacatgtcctggttgacatgtccagtaagaagactatcacaggtctttggaacattcttttgagagaaacctatttaggtccttggtctgtttttcaatcaggttgtttgatttttgctattgagttgttggaattccttatgtattcagatatttgccccttctgccatgtaggttttgcaaatattttctctcattttctgggttatcttttcactcggttgattgtttcctttgctgtgcagatgctttagcgttaaatgaagccacacttgtctattttcccttttattgcctgtgcctttggtgtcatagccaagaaatcattacctacatcaatgtcaaaagctttatccttctatacacttctagtagtttatggtttcagttgttacatttaggttttcaattcattctgagttgatgttcctacatggtgtgagataaagatttaaatacatacatatataaaatcatgaggtagtgtacactataaatatacaattgttaattgttactcaagtctaagtagaggtggaaataataaactttcttttttttacttaaaccactctgtgtcactgagctgatttcacctttagcctgataaaatcattgtcctctccaccctgattcctacaggagactactcaccccataacctcaaaaacctcttcatgaggatggtaagtcacctgaatcctgaagtgaattactcgctattccattggaactcatataggacaccagaatctagacctccagagaacagcaggacccatcttcagaaaataagaagcatttgttccctgagcctgttgaatcaaagtgcaatttctattctttttggaatgttaaaaagtgaatcataatatttaagcaggtgaacccacgagtaacatagcagggtctttcttgtcattattagctccaacctagcacagacattaaaggtacagatgtatactagcatgaaactgggagaacaggagcattcgagcaaccttgagaccaatgggcctctcttataaaatgcacacctcctctcactgagattgaggaaggtttcttgtctccgagccttctcccagtagagctataaatccaggctggctcctccctccccacacagctgctcctgctctccctcctccaggtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggtgagagaggcaggcatgcagagctgctaagtctagagggaaggacgggagagaggttccagagttgggtctcagcagtctatgtcactgaggtggcttcacttagaatctctgggcattgattttctcatctagaaattgaacagagagccaaataaacctgagaaactttatttctccaaagacttgattccaagaaacatctgtgaaattcactaagtttaagatatgaagagacagactagttatttctggatctaaacaagtagacttagttgtaaagagaacattttactctatctacagaagagcttttaaaaactgcagccaagcctgagggtaagttcaggtgtgtgtgtgatggggcaggaatgcaaaaatgagagcaaaggagaatgagtctcaaattctgtgtgacaagcactgctctgcgtgtttattcctatcgactgaggttgttcgtgctaccggctgcaatgcagccagcatcacctgtcagctagcatgtgacttccccgagattctttttcttacccactgctaactccatactcaatttctcatgctctccctgtcccaggctcaaggaaaaacatggactgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttcctttcctcatctcaaataaatgccttgttacaagatttctgtgtttccacctctttaatgtgtgatatgtgtctgtgtcaagacacttgggatacacgtaccaaaacgcaaaatcaaatttttgaacaatata

SEQ ID NO: 3013 - DNA, 644 bp; single-stranded, linear
cgctgcbbtctgctccggggctgcbgcbbcctcbtcbgctcttgcctggbgtggctcbgcctgggcctgcbgggccbccbggbgbbtggcbgcbbggbtggcgbgggtcctcbtggctggggtcbcctggbggbgggbgbgcbgggggtcctcbtggctggggtccctctctcccgtcctcctaccttgctatagaagacctgggacagaggactgctgtctgccctctctggtcaccctgcctagctagaggatctgtgaccccagccatgaggaccctcgccatccttgctgccattctcctggtggccctgcaggcccaggctgagccactccaggcaagagctgatgaggttgctgcagccccggagcagattgcagcggacatcccagaagtggttgtttcccttgcatgggacgaaagcttggctccaaagcatccaggctcaaggaaaaacatggactgctattgcagaataccagcgtgcattgcaggagaacgtcgctatggaacctgcatctaccagggaagactctgggcattctgctgctgagcttgcagaaaaagaaaaatgagctcaaaatttgctttgagagctacagggaattgctattactcctgtaccttctgctcaatttccttt

SEQ ID NO: 3014 - DNA, 5036 bp; single-stranded, linear
gccaccatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgcctccatctggatcctgtcctttatcctggccattcctgaagcgattggcttcgtcatggtaccctttgaatataggggtggacagcataaaacctgtatgctcaatgccacatcaaaattcatggagttctaccaagatgtaaaggactggtggctcttcgggttctatttctgtatgcccttggtgtgcactgcgatcttctacaccctcatgactggtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctgaattcgggaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtatcccgaattcgaattcgggaaaaagtgaaggtgtaaaagcagcacaagtgcaataagagatatttcctcaaatttgcctcaagatggaaaccctttgcctcagggcatccttttggctggcactggttggatgtgtaatcagtgataatcctgagagatacagcacaaatctaagcaatcatgtggatgatttcaccacttttcgtggcacagagctcagcttcctggttaccactcatcaacccactaatttggtcctacccagcaatggctcaatgcacaactattgcccacagcagactaaaattacttcagctttcaaatacattaacactgtgatatcttgtactattttcatcgtgggaatggtggggaatgcaactctgctcaggatcatttaccagaacaaatgtatgaggaatggccccaacgcgctgatagccagtcttgcccttggagaccttatctatgtggtcattgatctccctatcaatgtatttaagctgctggctgggcgctggccttttgatcacaatgactttggcgtatttctttgcaagctgttcccctttttgcagaagtcctcggtggggatcaccgtcctcaacctctgcgctcttagtgttgacaggtacagagcagttgcctcctggagtcgtgttcagggaattgggattcctttggtaactgccattgaaattgtctccatctggatcctgtcctttatcctggccattcctgaagcgattggcttcgtcatggtaccctttgaatataggggtgaacagcataaaacctgtatgctcaatgccacatcaaaattcatggagttctaccaagatgtaaaggactggtggctcttcgggttctatttctgtatgcccttggtgtgcactgcgatcttctacaccctcatgacttgtgagatgttgaacagaaggaatggcagcttgagaattgccctcagtgaacatcttaagcagcgtcgagaagtggcaaaaacagttttctgcttggttgtaatttttgctctttgctggttccctcttcatttaagccgtatattgaagaaaactgtgtataacgagatggacaagaaccgatgtgaattacttagtttcttactgctcatggattacatcggtattaacttggcaaccatgaattcatgtataaaccccatagctctgtattttgtgagcaagaaatttaaaaattgtttccagtcatgcctctgctgctgctgttaccagtccaaaagtctgatgacctcggtccccatgaacggaacaagcatccagtggaagaaccacgatcaaaacaaccacaacacagaccggagcagccataaggacagcatgaactgaccacccttagaagcactcctcggtactcccataatcctctcggagaaaaaaatcacaaggcaactgtgagtccgggaatctcttctctgatccttcttccttaattcactcccacacccaagaagaaatgctttccaaaaccgcaagggtagactggtttatccacccacaacatctacgaatcgtacttctttaattgatctaatttacatattctgcgtgttgtattcagcactaaaaaatggtgggagctgggggagaatgaagactgttaaatgaaaccagaaggatatttactacttttgcatgaaaatagagctttcaagtacatggctagcttttatggcagttctggtgaatgttcaatgggaactggtcaccatgaaactttagagattaacgacaagattttctactttttttaagtgatttttttgtccttcagccaaacacaatatgggctcaagtcacttttatttgaaatgtcatttggtgccagtatcccgaattc

SEQ ID NO: 3015 - DNA, 9372 bp; single-stranded, linear
ggbgctgbtbctgcbgatttcbgbgggbbgbbccctgbtbctcbccbgcttcbgctctggbgcbcbbgbgbbbgbgcbgcbgggggbgbggbbgbbgcbgcbtcttcccbgbgbggctgcctgbgcbbbtgctggttttcctttccbgtcttgggttttbtbbctcccbgbbggcbbgbgbggggcbbggcgttttcttctctcgctggttttcctttcctggcagtgggtgggggtgggggtggggtggcttccttgttcctgggggtgtcctcttgctctgggcttttctccccttttccttcctgtctgttttcctggggctctcctctgtctctgtgtccttgccctggccctcttccctctcctgtctcctgtccctgtgttccgcccgtcttccctctcctgacctccttttcctccgctgggtggggccctgcctgttctctgctccctggcttggggtttcttctgtgtgtcttcttcctctgttggctggctttctccttcttttgtcttcctgggtgccccttcttcctttcttgggtccttggtgcttgggctgggtcccagttaatacataatcaatatgcaatttattaatacatctctccatgtccactccccctgtatcttgccattcttgacctgcatttccatcctccttaccttccctagaggccaactcattttctttgaaaaacctggcatttcccagaaaaaaaagtgaagggctgggagctgtccgttgtcctgatttgctccctctgcccttgcttccaaatgtggttggaaagaagcactattgaaaaatccctaaacgcacccctgcagggttggctctaccctgtagccatggacacatgctgttgataccacctgcctcatgagtctcacataatttgccctttcacactatctaccccatcagccttaccaaaaccatacctgcatcctgggcagcatctgcccttcaagagactaaggaatctccttgcaaccaagaatgactagaccaatgagacaccctttaaggccccagcacaatatagaaatcccacaatatggtaatcccagtaaggagctatcaagccattgcaggaccatctagaatacaactagagtatagttcctttcaatccaggaactatactctaacagcttggctcacaggaaccagaagtgaagatgatgaggatcagggctgagcctgtgagcaccagctccaccactgacaccaaccacagattaaacaagcatcttgtggacccctgggatggaaagaatagttgttgccttatcaacctcccccacagcccacacagaaaagataaaatcatcatggctacagtgttacagaagatgatgacccaaggagtaggcctgcctgagtgaatgctgagagtgataatgggagcagtagcatctcagagactacagcagaaaccatccacataaagagctttgcccaaacttatgataaagggcaccctcagagactctccctactttaatattagcccattgcagaaatggtgagtggaaagagaaatcttaggaagaaccccttaaaaaagcaaaatgctttttaggtttgtgctgaagagcctggaaaagaaataaggacacacacgctgagaaatcttcctcctgccccaacactgggataatctccaaggatctctccatatctcattctcctggatacactgtccactcagaaatattgtgcagagtgcagtaattcaaaagtgagctattgtgttaggagtgaaggcaagagtatcgtaaaataaatcaaatttgaaatgaattctcttaaattgctttatagatgtttaatgtaagccagcagctattaaacgataaaccttaaattcgagaaaaacttggtcattcagaaactatagaaacaggcaggacttattgcgagggcaaacacagagtgagctccagcctgcttcaggaaaatctgccagtgccatgaaggatgtactctgtctgctccactgcactactgctcagtatgagcccatgccatcagctgtccctgacccacaggagttctttagaagagactggtcaacaaaagtttctagggtgttttatacctgccaactcgagggttaaaacaagttgcatagaaatgctcaatcaagaaagacacagtcattactcagagaataataaacagcctggcagcacatgaatgaatagaaaaaagatgttacatgcaaagcatgaaataaccaaattccataacagatgttaatctgtaatgtgtttaggagaatttagaggaagtataagatttattctttcatcaaaaaaattatagccaatgaggatatatctatcaattatccatcaagtggtgatatggcagcacaaggtaaaacacaaaggaataaaaccaacgtttattaagaaccaatcatgtggcatttcacattgagcatcatatttaattctgaaaaaaatccttgtactgtatcattcttcatattttatggatgcagtaactaaggctgagaactttaaaatttttcctaagttcagacacatagctaagtggcagaaccaagattcaaactcaccccatctaactgcagagcaaactgcatgccttaaatgtcaaagtgaatactagcacagttaatacaatgtttggaaactcagagaaggaatgatccctctgcattatagttactaaggaatcattgccattatttaaatgccagtgcttctacatcaggcccaaattttctgtcctactaactgtgaatcaagacttgattcaacctctacttgagtatctgccgcaatgagaaatcacttacctccactaaccacacatttattttataacaacagattgttagtaagtcctttcttatacatactcaacagctgcttcccaagatgctgtaggattatgtctagagtcaaactagccagaagcaatgtccaaaatacaccataacactgtgcagcaaaggtcctactaccacttgtttggcccaaacattctaggcagcactggatatctgaatcatcaattatttccacaaacactgacccctctaccagtcaccctcactagaagaattaattccacatgataatagctccctcatgttactcccttctaagtcaaattgtacacccctttatctgattaacagagtctaagtcacatgacctaaatgcaagagaactgggaatggacgtttgtggattctaccttagtaaggcaaagttatcattgggaattcctctaatacaggaagggtgttccagagacattaaggagccatataaatggaaaatgtccactacaatccatcacttggttgccccacatcaacattcattcttttgccacacttaaagtttccaagaacaaaaattatcccactgaacataatctttactatcttttatataaaggaaaattagacttgactcagcagaactgaaataacccagctctaacagttactgcttttaacttcaagtactgtgtctctaggtgatacctgctccaacaatagtttggtcacattttcaatttgatattctctagtctcccaacttgataactgtaccctaaaccataaagttcactaccaacatgctatatataaaataaccaaagggggaagaagaaagagaaaaaggaaatctcttaaaatacacaggtatacatatgacaaagcaaagaaggaaatgtgagcagatagtgcagtcctcgtttctgaaattggtcccctgactggggctatacctattccatttcctcaccctcagccaggcaggtggagcaaaaacttaagtcttggtggatctgaatcttgatgctgtggagctgtcttactagccccagactacctgcctctcaatttctaattatatcagtgaaagcaaacagctttgatttgtttaagcctctgattttttggtctaactgatgtaagaccacaaggacaagagttctccagctccggattctcttctgttctgttaatggtgaaatgcccgagagaagagttgccaactttggcaaataaaaaatacaggattccagttaaattcaaatttagataaacaacaattttttagtattagtgtgtcccattcaatatttggacatacttaactaaaaaatgatttgttgttcatctgaaatacaaatttaactgggcattctgaatattctctggcaacccccgagagagtgaagaaagtggtacaaggacacttaagaagaccagatttgaaaagacattacggatgtgtttaaatgtcttattctagagagagttagagctgtaggtagaacttgggaaattaagttaaaagcagacacagagacctggccaatatatactaaggagtggatcactctggtcacaagcccaacctgagaccaagggcatagtgagatgatttgggaaaggcacttatacactactcatccccgtctttgaactaaatgccttataaatctccaagagaaatgacagtccaccatgtggactgctttctgtaagtccagggaaaataaaagctatgtgcttgaaacccacttctgatattataaggtgtgtgatctttgtcatgttaatgggtctgagtatcaattctacaattgtaaagtgacagtaatggtgtgtccccaggttgttgtggaaagcttgattcttaatgcaacagtaggaaaccccagcctctctggagcaaacacccttctacatctttacttcccctgcacattggcaggactctattcctctatttctctctagtgctagagcagaaagggaccttgatttgatatcaggaaaatctatttctgaaccataagctatgatagctgatttaaaaaattgactatcatgacatgataatgatcataatggtaatacatattgatagggttgccgtgaaagtaataatatatctaagagttgtgacaatatatgatacgcctagactctcagaaaatgctaattccaatcccaattgctctttgcataaagttctgtcctagggtctgttcttttcccacatctaccctccttggatctctcttctgtctttttcatgtggttcagaggaggagagagatccaggtcaatgtttttcaaattacaaggaattatcatttaaatggggaagaagctcaagttttgacgtgtagtggaattggagtggagtggagtggaatggaaactaacaggaagacactgcacatggttaagataaagattgtttcctgaaacctttaatttgtgcttacatactcacacatacatatgtgcatgcactgggactctgcaatatgcatttctgactatggaacatagccataaaagtctttgcactgaacgttcagtgggcctttcacaagctgccctaattgggaaagaaaaacatggtccctccatttcctgcccccaactccagaaaagtcaccatagttgagggtacatctgagaagccagcacttgggagttcagggctcaagttcctttctagaaaaacactgggtgattctaggggaacttccgatcagaaacagccaattcagagtgagagaagaaaacgtgaccatgcagttcctgtggttaccagccttgcccctctcttgccttctgggagttataaaacccaagactggaaaggaaaaccagcatttgctcaggcagcctctctgggaagatgctgcttcttcctctccccctgctgctctttctcttgtgctccagagctgaagctggtgagtatcagggttcttccctctgaaatctgcagtatcagctcctgaaacaaagatgtttagtctgaaatagctgactcctaaacagggttccaagatctctcttcaagagtcccacagaggaaatttccacttgggatgtgtgccaccccacccccacccccacccactgccattctctacagcctaggacacccccaggaacaaggaatttcacctcaattgtagaaaagcccagagcaagtggaaggaaaaggggtatccccaggaaaacagacatgtcctcttaatcttctgagcatcagggctacccattactttgtgactttctcactctgtgaccatgctcaagagctatggagaaatctaaaacaggaacctggacagtgggtcctacacagagacagaggagagtgggccagggcaaggtgggagtgggagaagtctgagatgaaaacatcagaatggagcagaggcaagaatgagatttcacctgggaggttatgggtggggaaagatacgaaatacaggagacaggagagggaagatgggcggaacacagggtgagaatgagattccagggaagcctagctcagctttaacccaatttgtccattcattggagagagtatctatggccgtgttcaaaccctggggtgctctgttccaggggagatcatcgggggcacagaatgcaagccacattcccgcccctacatggcctacctggaaattgtaacttccaacggtccctcaaaattttgtggtggtttccttataagacggaactttgtgctgacggctgctcattgtgcaggaaggtgagacaacagggtctatttatctccaaatgggagatgaacaaccagagtagcatccaggaatacacctgcactggggactgaagagggggtcctgggtcttgtcaactttcaggagagggaagactttgggctgaaagactttagtctgtgtttgaatagttccttgagcctcagtcactgagctaagctcccttcggaggaaaaggaggtcctgtccgaaggtccctcttgttgcagtagcacccctcacccctacccaactcaagacacacggctcacttttcagggccccacccagtctcagggccacttcctctatggccttttcaagaacactggctctagttctcagggtcctgaacccatcattttatgggagcagagaacaggtctacataagacccccactttcccgttttaactgatatctcctgcttcaggggctggccctcatgcagggttccctgaattaggaagtgtgaaccctgtcccctgagtcctccctggcctgttcagtccccagcaattccaggggtcgtagaaattgtgtctgtttcctgagaaagctctttcatgagttaagcctgagccctcaaatgccacaagtggcccatgaaaagggagatgggtagagtccggcnacccagtgacagagtttagtcctcttttctcagaatgagctcacctcagaagaaaccccaagccatcactgtcgcctccttttccttccttcttcctcacagcaggtctataacagtcacccttggagcccataacataacagaggaagaagacacatggcagaagcttgaggttataaagcaattccgtcatccaaaatataacacttctactcttcaccacgatatcatgttactaaaggtgacaacacctctcttctccctttccacttcccattctcctaagcttctccttcaggtcctcattgccctgaatttttcttaggacttggctataacatgaagctactcaccctgtccctccctgatcacctccaactgtccagagcccatttcgaggactgacagtccttcattcccttcacagttgaaggagaaagccagcctgaccctggctgtggggacactccccttcccatcacaattcaactttgtcccacctgggagaatgtgccgggtggctggctggggaagaacaggtgtgttgaagccgggctcagacactctgcaagaggtgaagctgagactcatggatccccaggcctgcagccacttcagagactttgaccacaatcttcagctgtgtgtgggcaatcccaggaagacaaaatctgcatttaaggtgatcctccaactaggtttcctctccaaaactcactgttcagggacctgaatgctcttagaaggagatggggtcagcaggttgtcagtcaggtgacagggtgagcatcacaggaattgctgtcctcccgtggtccaagacagcctctgaccatccattccagtctactgcactgggggcatggggtgactgtggagaatgtggatgacggtcccaagaaaggaagaaggggcatcagaactagatgtataagtgaggagctccacctcctgggtctgactttaggtctcactgtgactccaagctggctggcagacaggagtggaggacttcccgggctcaccttcttctctctctcctccccctacagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaatcctggatcctgagccagcctgaagggaagctggaactggaccttagcagcaaagtgtgtgcaactcattctggttctacccttggttccctcagccacaaccctaagcctccaagaggtctcctacaggtaacagaactttcaataaacttcagtgaagacacagcttctagtcgtgagtgtgtgtccctctctgctgctctcttctcctgcacatgtgacctgattcccagcccaagcaccaaggaatcatcgggggcacagaatccaagccacattcccgcccctacatggcctacctggaaattgtaacttccaacggtccctcaaaattttgtggtggtttccttataagacggaactttgtgctgacggctgctcattgtgcaggaaggtctataacagtcacccttggagcccataacataacagaggaagaagacacatggcagaagcttgaggttataaagcaattccgtcatccaaaatataacacttctactcttcaccacgatatcatgttactaaagttgaaggagaaagccagcctgaccctggctgtggggacactccccttcccatcacaattcaactttgtcccacctgggagaatgtgccgggtggctggctggggaagaacaggtgtgttgaagccgggctcagacactctgcaagaggtgaagctgagactcatggatccccaggcctgcagccacttcagagactttgaccacaatcttcagctgtgtgtgggcaatcccaggaagacaaaatctgcatttaagggagactctgggggccctcttctgtgtgctggggtggcccagggcatcgtatcctatggacggtcggatgcaaagccccctgctgtcttcacccgaatctcccattaccggccctggatcaaccagatcctgcaggcaaattaa

SEQ ID NO: 3016 - DNA, 3117 bp; single-stranded, linear
ctgccccbgtttttgbtcctcbcbtgccgtggggbggbcbbtggctgcctccccggggtttctgctgcttgctgcttctttcccgtctcccttctttcccgtctcctttttgcctctttgggttcctgttgtttctggcctgcttggtggcggcttgtgcgtttcctctctcttctcttgggtctccgcttctcgtcctgccttttcctgtctctgtcgcgccgttcctcctccggcgtcctcctgccctgtgctgtttgcctcgggtggtgcgggtcccggtgctcccccggcgggccggctggttgcctgggcctgtctggtggggtgtggggccgctgggttgggggtgtggtgggctcttctgtggcctgtggggctgttggtgtctctgtgggcgtgtgctgggtcttggggcttcctcccttgtgctgggtgcggcctccccgccccccttctgggccggtggcctggctccttgtgggcgcttctggctcttgccctgtccttcttcgcctcgtggctgctgggctgccatatgtatgggaatactgtatttcaggcattataaggaatgaaattataggccgggcattgtggctaacccttgtaatcctagcactttgagaggctgaagtgggcagatcacttgagcttcagagttcgagaccagcatggacaacatggtgaaacccagtctctaccaaaaacacaaaaatattagctgggtgtggtggtgcatgcctgtagtcccagctactcaggaggctgaggtgggaggatcgcttgagcctgggaggcagaagttgcaatgagcagagatcgtgccactccgctccagtcttggtgacagaatgagactccatctcaaaaataaataaataaataaataaaataaatgaaatgaaattataagaaattaccactttttcatgtaagaagtgatcatttccattataagggaaggaatttaatcctacctgccattccaccaaagcttacctagtgctaaaggatgaggtgttagtaagaccaacatctcagaggcctctctgtgccaatagccttccttcctttcccttccaaaaacctcaagtgactagttcagaggcctgtctggaataatggcatcatctaatatcactggccttctggaacctgggcattttccagtgtgttccatactgtcaatattcccccagcttcctggactcctgtcacaagctggaaaagtgagaggatggacagggattaaccagagagctccctgctgaggaaaaaatctcccagatgctgaaagtgaggccatgtggcttggccaaataaaacctggctccgtggtgcctctgtcttagcagccaccctgctgatgaactgccaccttggacttgggaccagaaagaggtgggttgggtgaagaggcaccacacagagtgatgtaacagcaagatcaggtcacccacaggccctggcagtcacagtcataaattagctaactgtacacaagctggggacactccctttggaaaccaaaaaaaaaaaaaaaaaaaagagacctttatgcaaaaacaactctctggatggcatggggtgagtataaatacttcttggctgccagtgtgttcataactttgtagcgagtcgaaaactgaggctccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaaggtgagttgcccatatgtatgggaatactgtatttcaggcattataaggaatgaaattataggccgggcattgtggctaacccttgtaatcctagcactttgagaggctgaagtgggcagatcacttgagcttcagagttcgagaccagcatggacaacatggtgaaacccagtctctaccaaaaacacaaaaatattagctgggtgtggtggtgcatgcctgtagtcccagctactcaggaggctgaggtgggaggatcgcttgagcctgggaggcagaagttgcaatgagcagagatcgtgccactccgctccagtcttggtgacagaatgagactccatctcaaaaataaataaataaataaataaaataaatgaaatgaaattataagaaattaccactttttcatgtaagaagtgatcatttccattataagggaaggaatttaatcctacctgccattccaccaaagcttacctagtgctaaaggatgaggtgttagtaagaccaacatctcagaggcctctctgtgccaatagccttccttcctttcccttccaaaaacctcaagtgactagttcagaggcctgtctggaataatggcatcatctaatatcactggccttctggaacctgggcattttccagtgtgttccatactgtcaatattcccccagcttcctggactcctgtcacaagctggaaaagtgagaggatggacagggattaaccagagagctccctgctgaggaaaaaatctcccagatgctgaaagtgaggccatgtggcttggccaaataaaacctggctccgtggtgcctctgtcttagcagccaccctgctgatgaactgccaccttggacttgggaccagaaagaggtgggttgggtgaagaggcaccacacagagtgatgtaacagcaagatcaggtcacccacaggccctggcagtcacagtcataaattagctaactgtacacaagctggggacactccctttggaaaccaaaaaaaaaaaaaaaaaaaagagacctttatgcaaaaacaactctctggatggcatggggtgagtataaatacttcttggctgccagtgtgttcataactttgtagcgagtcgaaaactgaggctccggccgcagagaactcagcctcattcctgctttaaaatctctcggccacctttgatgaggggactgggcagttctagacagtcccgaagttctcaaggcacaggtctcttcctggtttgactgtccttaccccggggaggcagtgcagccagctgcaaggtgagttgcc

SEQ ID NO: 3017 - DNA, 8222 bp; single-stranded, linear
ctgctttaaaatctctcggccacctttgatgaggggactgggcagttctagacagtcccgaagttctcaaggcacaggtctcttcctggtttgactgtccttaccccggggaggcagtgcagccagctgcaagccccacagtgaagaacatctgagctcaaatccagataagtgacataagtgacctgctttgtaaagccatagagatggcctgtccttggaaatttctgttcaagaccaaattccaccagtatgcaatgaatggggaaaaagacatcaacaacaatgtggagaaagccccctgtgccacctccagtccagtgacacaggatgaccttcagtatcacaacctcagcaagcagcagaatgagtccccgcagcccctcgtggagacgggaaagaagtctccagaatctctggtcaagctggatgcaaccccattgtcctccccacggcatgtgaggatcaaaaactggggcagcgggatgactttccaagacacacttcaccataaggccaaagggattttaacttgcaggtccaaatcttgcctggggtccattatgactcccaaaagtttgaccagaggacccagggacaagcctacccctccagatgagcttctacctcaagctatcgaatttgtcaaccaatattacggctccttcaaagaggcaaaaatagaggaacatctggccagggtggaagcggtaacaaaggagatagaaacaacaggaacctaccaactgacgggagatgagctcatcttcgccaccaagcaggcctggcgcaatgccccacgctgcattgggaggatccagtggtccaacctgcaggtcttcgatgcccgcagctgttccactgcccgggaaatgtttgaacacatctgcagacacgtgcgttactccaccaacaatggcaacatcaggtcggccatcaccgtgttcccccagcggagtgatggcaagcacgacttccgggtgtggaatgctcagctcatccgctatgctggctaccagatgccagatggcagcatcagaggggaccctgccaacgtggaattcactcagctgtgcatcgacctgggctggaagcccaagtacggccgcttcgatgtggtccccctggtcctgcaggccaatggccgtgaccctgagctcttcgaaatcccacctgaccttgtgcttgaggtggccatggaacatcccaaatacgagtggtttcgggaactggagctaaagtggtacgccctgcctgcagtggccaacatgctgcttgaggtgggcggcctggagttcccagggtgccccttcaatggctggtacatgggcacagagatcggagtccgggacttctgtgacgtccagcgctacaacatcctggaggaagtgggcaggagaatgggcctggaaacgcacaagctggcctcgctctggaaagaccaggctgtcgttgagatcaacattgctgtgatccatagttttcagaagcagaatgtgaccatcatggaccaccactcggctgcagaatccttcatgaagtacatgcagaatgaataccggtcccgtgggggctgcccggcagactggatttggctggtccctcccatgtctgggagcatcacccccgtgtttcaccaggagatgctgaactacgtcctgtcccctttctactactatcaggtagaggcctggaaaacccatgtctggcaggacgagaagcggagacccaagagaagagagattccattgaaagtcttggtcaaagctgtgctctttgcctgtatgctgatgcgcaagacaatggcgtcccgagtcagagtcaccatcctctttgcgacagagacaggaaaatcagaggcgctggcctgggacctgggggccttattcagctgtgccttcaaccccaaggttgtctgcatggataagtacaggctgagctgcctggaggaggaacggctgctgttggtggtgaccagtacgtttggcaatggagactgccctggcaatggagagaaactgaagaaatcgctcttcatgctgaaagagctcaacaacaaattcaggtacgctgtgtttggcctcggctccagcatgtaccctcggttctgcgcctttgctcatgacattgatcagaagctgtcccacctgggggcctctcagctcaccccgatgggagaaggggatgagctcagtgggcaggaggacgccttccgcagctgggccgtgcaaaccttcaaggcagcctgtgagacgtttgatgtccgaggcaaacagcacattcagatccccaagctctacacctccaatgtgacctgggacccgcaccactacaggctcgtgcaggactcacagcctttggacctcagcaaagccctcagcagcatgcatgccaagaacgtgttcaccatgaggctcaaatctcggcagaatctacaaagtccgacatccagccgtgccaccatcctggtggaactctcctgtgaggatggccaaggcctgaactacctgccgggggagcaccttggggtttgcccaggcaaccagccggccctggtccaaggcatcctggagcgagtggtggatggccccacaccccaccagacagtgcgcctggaggacctggatgagagtggcagctactgggtcagtgacaagaggctgcccccctgctcactcagccaggccctcacctactccccggacatcaccacacccccaacccagctgctgctccaaaagctggcccaggtggccacagaagagcctgagagacagaggctggaggccctgtgccagccctcagagtacagcaagtggaagttcaccaacagccccacattcctggaggtgctagaggagttcccgtccctgcgggtgtctgctggcttcctgctttcccagctccccattctgaagcccaggttctactccatcagctcctcccgggatcacacgcccacggagatccacctgactgtggccgtggtcacctaccacaccggagatggccagggtcccctgcaccacggtgtctgcagcacatggctcaacagcctgaagccccaagacccagtgccctgctttgtgcggaatgccagcgccttccacctccccgaggatccctcccatccttgcatcctcatcgggcctggcacaggcatcgtgcccttccgcagtttctggcagcaacggctccatgactcccagcacaagggagtgcggggaggccgcatgaccttggtgtttgggtgccgccgcccagatgaggaccacatctaccaggaggagatgctggagatggcccagaagggggtgctgcatgcggtgcacacagcctattcccgcctgcctggcaagcccaaggtctatgttcaggacatcctgcggcagcagctggccagcgaggtgctccgtgtgctccacaaggagccaggccacctctatgtttgcggggatgtgcgcatggcccgggacgtggcccacaccctgaagcagctggtggctgccaagctgaaattgaatgaggagcaggtcgaggactatttctttcagctcaagagccagaagcgctatcacgaagatatcttcggtgctgtatttccttacgaggcgaagaaggacagggtggcggtgcagcccagcagcctggagatgtcagcgctctgagggcctacaggaggggttaaagctgccggcacagaacttaaggatggagccagctctgcattatctgaggtcacagggcctggggagatggaggaaagtgatatcccccagcctcaagtcttatttcctcaacgttgctccccatcaagccctttacttgacctcctaacaagtagcaccctggattgatcggagcctcctctctcaaactggggcctccctggtcccttggagacaaaatcttaaatgccaggcctggcgagtgggtgaaagatggaacttgctgctgagtgcaccacttcaagtgaccaccaggaggtgctatcgcaccactgtgtatttaactgccttgtgtacagttatttatgcctctgtatttaaaaaactaacacccagtctgttccccatggccacttgggtcttccctgtatgattccttgatggagatatttacatgaattgcattttactttaatcgaattcccactctgctgcctgctccagcagacggacgcacagtaacatgggcaacttgaagagcgtggcccaggagcctgggccaccctgcggcctggggctggggctgggccttgggctgtgcggcaagcagggcccagccaccccggcccctgagcccagccgggccccagcatccctactcccaccagcgccagaacacagccccccgagctccccgctaacccagcccccagaggggcccaagttccctcgtgtgaagaactgggaggtggggagcatcacctatgacaccctcagcgcccaggcgcagcaggatgggccctgcaccccaagacgctgcctgggctccctggtatttccacggaaactacagggccggccctcccccggccccccggcccctgagcagctgctgagtcaggcccgggacttcatcaaccagtactacagctccattaagaggagcggctcccaggcccacgaacagcggcttcaagaggtggaagccgaggtggcagccacaggcacctaccagcttagggagagcgagctggtgttcggggctaagcaggcctggcgcaacgctccccgctgcgtgggccggatccagtgggggaagctgcaggtgttcgatgcccgggactgcaggtctgcacaggaaatgttcacctacatctgcaaccacatcaagtatgccaccaaccggggcaaccttcgctcggccatcacagtgttcccgcagcgctgccctggccgaggagacttccgaatctggaacagccagctggtgcgctacgcgggctaccggcagcaggacggctctgtgcggggggacccagccaacgtggagatcaccgagctctgcattcagcacggctggaccccaggaaacggtcgcttcgacgtgctgcccctgctgctgcaggccccagatgagcccccagaactcttccttctgccccccgagctggtccttgaggtgcccctggagcaccccacgctggagtggtttgcagccctgggcctgcgctggtacgccctcccggcagtgtccaacatgctgctggaaattgggggcctggagttccccgcagcccccttcagtggctggtacatgagcactgagatcggcacgaggaacctgtgtgaccctcaccgctacaacatcctggaggatgtggctgtctgcatggacctggatacccggaccacctcgtccctgtggaaagacaaggcagcagtggaaatcaacgtggccgtgctgcacagttaccagctagccaaagtcaccatcgtggaccaccacgccgccacggcctctttcatgaagcacctggagaatgagcagaaggccagggggggctgccctgcagactgggcctggatcgtgccccccatctcgggcagcctcactcctgttttccatcaggagatggtcaactatttcctgtccccggccttccgctaccagccagacccctggaaggggagtgccgccaagggcaccggcatcaccaggaagaagacctttaaagaagtggccaacgccgtgaagatctccgcctcgctcatgggcacggtgatggcgaagcgagtgaaggcgacaatcctgtatggctccgagaccggccgggcccagagctacgcacagcagctggggagactcttccggaaggcttttgatccccgggtcctgtgtatggatgagtatgacgtggtgtccctcgaacacgagacgctggtgctggtggtaaccagcacatttgggaatggggatcccccggagaatggagagagctttgcagctgccctgatggagatgtccggcccctacaacagctcccctcggccggaacagcacaagagttataagatccgcttcaacagcatctcctgctcagacccactggtgtcctcttggcggcggaagaggaaggagtccagtaacacagacagtgcaggggccctgggcaccctcaggttctgtgtgttcgggctcggctcccgggcatacccccacttctgcgcctttgctcgtgccgtggacacacggctggaggaactgggcggggagcggctgctgcagctgggccagggcgacgagctgtgcggccaggaggaggccttccgaggctgggcccaggctgccttccaggccgcctgtgagaccttctgtgtgggagaggatgccaaggccgccgcccgagacatcttcagccccaaacggagctggaagcgccagaggtaccggctgagcgcccaggccgagggcctgcagttgctgccaggtctgatccacgtgcacaggcggaagatgttccaggctacaatccgctcagtggaaaacctgcaaagcagcaagtccacgagggccaccatcctggtgcgcctggacaccggaggccaggaggggctgcagtaccagccgggggaccacataggtgtctgcccgcccaaccggcccggccttgtggaggcgctgctgagccgcgtggaggacccgccggcgcccactgagcccgtggcagtagagcagctggagaagggcagccctggtggccctccccccggctgggtgcgggacccccggctgcccccgtgcacgctgcgccaggctctcaccttcttcctggacatcacctccccacccagccctcagctcttgcggctgctcagcaccttggcagaagagcccagggaacagcaggagctggaggccctcagccaggatccccgacgctacgaggagtggaagtggttccgctgccccacgctgctggaggtgctggagcagttcccgtcggtggcgctgcctgccccactgctcctcacccagctgcctctgctccagccccggtactactcagtcagctcggcacccagcacccacccaggagagatccacctcactgtagctgtgctggcatacaggactcaggatgggctgggccccctgcactatggagtctgctccacgtggctaagccagctcaagcccggagaccctgtgccctgcttcatccggggggctccctccttccggctgccacccgatcccagcttgccctgcatcctggtgggtccaggcactggcattgcccccttccggggattctggcaggagcggctgcatgacattgagagcaaagggctgcagcccactcccatgactttggtgttcggctgccgatgctcccaacttgaccatctctaccgcgacgaggtgcagaacgcccagcagcgcggggtgtttggccgagtcctcaccgccttctcccgggaacctgacaaccccaagacctacgtgcaggacatcctgaggacggagctggctgcggaggtgcaccgcgtgctgtgcctcgagcggggccacatgtttgtctgcggcgatgttaccatggcaaccaacgtcctgcagaccgtgcagcgcatcctggcgacggagggcgacatggagctggacgaggccggcgacgtcatcggcgtgctgcgggatcagcaacgctaccacgaagacattttcgggctcacgctgcgcacccaggaggtgacaagccgcatacgcacccagagcttttccttgcaggagcgtcagttgcggggcgcagtgccctgggcgttcgaccctcccggctcagacaccaacagcccctgagagccgcctggctttcccttccagttccgggagagcggctgcccgactcaggtccgcccgaccaggatcagccccgctcctcccctcttgaggtggtgccttctcacatctgtccagaggctgcaaggattcagcattattcctccaggaaggagcaaaacgcctcttttccctctctaggcctgttgcctcgggcctgggtccgccttaatctggaaggcccctcccagcagcggtaccccagggcctactgccacccgcttcctgtttcttagtccgaatgttagattcctcttgcctctctcaggagtatcttacctgtaaagtctaatctctaaatcaagtatttattattgaagatttaccataagggactgtgccagatgttaggagaactactaaagtgcctaccccagctc

SEQ ID NO: 3018 - DNA, 48300 bp; single-stranded, linear
ggtgbcbttgbgcbtgtcggcgcggtcccgttbbgbgtgggcccgccagcccagccactccacttgggggcgggtggccagcacgaacagcacccagaggaaggggggcggcccagaagggcagcccgcaggccaggatcaggtctgctgcggccggagataatggcattcaccacgcggcggcccagcgcacgccgcgcatccggcccgggttctgacctgcagcccccgtctccttggcattcctgggccccagtcactcctctccctgccccccttgctggggcagggacggggtgbcbttgbgcbtgtcggcgcggtcccgttbbgbgtgggcccgccagcccagccactccacttgggggcgggtggccagcacgaacagcacccagaggaaggggggcggcccagaagggcagcccgcaggccaggatcaggtctgctgcggccggagataatggcattcaccacgcggcggcccagcgcacgccgcgcatccggcccgggttctgacctgcagcccccgtctccttggcattcctgggccccagtcactcctctccctgccccccttgctggggcagggacggccgtgttgtcbgtggtgctgcccgtttgbggtbtggcgctccbccbbttcccttttctccttgttttccgtttctcttgccgtctgtggttcagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctggggggagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagacccaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccacctgtccctgcctcagttcccttttatgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaacctggagaggctagaaccaagaagggctagaacctggaggggctagaacctagagaagctaaaacctgagctagaagctggaggactagaacctggagggctggaatctgaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtgaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcaaaaaaaaaaaaaaaaaaaatgatagaccgtcaataatttgttaaatgctttttaaaatgaatgctttaagccgggtgcagtgcctcacatctgtaatcccagcactttggagccgagcgggtggattgtgtgaggtcaggagttcgagaccaacctggccaacatggcaaaacctcactctctaccaaaaatacaaaaattagccaggcatggtggcaggcacctgtgatcccagctactcaggaggctgagacaggagaatcgcttgaacccgggaggcaaggttgcagtgagccaagattacgccattgtactccagcctgggtgacagagagagactccgtctcaaaaaaaaaaaaaaaaaaaaaaaaattacgcttcaaacacatgatctctcaccactgttgaattttctttctatgagcccaggagggcctctcagagaggaaagctcctaggtcttcctttccctctgcaaactccctgccttgaaggttcagaaggactgtgcgtgctcgttgcatcctttgcaagtgtccaaaccctgatcccagctgtgcttaggggttcctgcaaaccttttccaggtgttaattacctcccacttcatttcctgtttaccaactcagctttttgttttagtgtgtttgaattccctgaactgaccgttgtctgatctccacctcccaactgaattaggggagctgggcttctggaaacccaggtgccgggtgttgcagagtggctgaaagctgggatgtggcagatccgtggctacattcatgcacacacacacacccacatacccacacatgcacacacacacacacacccgcactcacacacttggacatgcatagaccacagctttccacacccttcctagacaggggtcacttggtatcctggagagagtgtgaagtcctggaatggaaagaggggggattaagccccacctctagccatgggactgagacaagtcaccaccaacccatctgcgccttgtttacctcctctgtgaggcaagcacagagcccatgcctgcccccctggatgggagtgatgtgaaacttgaagggcggtcagagcaagggtcgggaatggaaggcccttgggaaaaaaggccctttcaactaggggcacagaggaggccctgggctgagaacttgacagcaccttgtaattggtaagccaagcccgaagggactggaaatactcagatgtgtctgtctcccttattaggttcaaagtccctcaagaccctgtctccatcacagtgctccagtccagacccctcctctgagctccagaccctgctggacccaaccagccctatggggtcgcatccccacctgcctggaattctccaaagaacctcccctttaacagttccagcctttaacagttccagtctaaacacatgacctttctcctctaaatcagccccccatctctgcctttgcaggagatggaagccatgacacctgcctcgcccctgtcctcaccccatccatgtccaatcaagcactaggcatgtcaggtttaccctctaaactcctctggaatccagtctctcagtctccatcatcccaggtcgaagctaatgggctaactggtccttgcttccactctacccccactgcagtcctgacttcctgagcagcagccagggcctaatcgatattcacaccaagcgccaacctgactgagatatcctcctgcaccatcatccctccaccctgtttagttctgctcaccctcagtgttctcatcaataatccactcccctcacaggcgcgtttgggaccccatgttctatgctctcacaggaccttttgcttgatttttcactgtacttaggtcagtttgcagttattaagtgactgagcaatgtctggcttctccagtagactgtcagctcctagccattgtatacctagcaccgctgtgtgggagcacgtgacaaacgtccagtgagtcagggactcagcagtctccatttctccgccctgctggagaatgcgtgtatttggcaatccccagcccctgtgccatctaaccatcttttcttctctgttcagcccaggtgtggcctcactcacatcccactctgagtccaaatgttctctccctggaagatatcaatgtttctgtctgttcgtgaggactccgtgcccaccacggcctctttcaggtgagtcaaagggattcctcagttcactagttaggggaggtgggcagacaccctggagaactccctggaaagctcaactctcatgccccggacaacagttgaaggaaccatggtgatgttaagcccaaagacaaaacctctcaggtgtccaagtccctgttggaatcttgggagcagagggaatgttctgtggtctagaggaagaggggctcagggaggagaagggcacattcctggttgttatatgtttctatctatcccagatgaacttggaagtgaagggaagagagttaaacattaaagtaaatacccagtggatcagacagcaatgtgccagattgccttggaaacaaaatatctccaacacatggctgacatttggtgggagatcagaacaccctaaagagagaatttaaggggagggggaggaggacctgagccagagtagaagcagaggatagggagatctgttcttggggacagcatttgcaagaaacaaggctgaggggtccactccaacctctccaccctgctgcaggtgctgcctatgatgaagatgagcagatggccatctcagctggggccacagtgcactggacctatagtttccaattccgcactcagcaggcatctttctgatgatccgatggcttctcagagccagggatgggccaggatccatccccttggctactgtcttgctgagaaatttataagcagcatctggtgctatactttggtctctagtgagttagctcatgaaagatgatagactctccaagccaggggtatgcaggaaatgggttttctgtagctacagaaatggggttgagggttggaccaagggactacccaggggaagtcttaccttcagaggactctggaaaggaggctgcaagttttcatgggtcaagaattcagagcccagtagagacagcttatctctgttccaagatgtctggggccttggttggaagattcaaaggctaggaaaccaggagccaccaaaagcgtaactggggccagaggatccactttcaaggtggcaagttggttccccccatgtggctgcttgagtatcctcacatggcggctcacatccttccaagtaagcaatgcaaaaggccaagaaagatgctgcaaagatgttatgacctagcctcagaaatcacacaccatccctgccaccattagtaagaagtccagcccacgtccaggagaagaggaagcagattcctccttttgaaatgaagaatatcaagtaattcggggggcatatgaaagccaccacacaccacagggatctttttagagcatacttcttataccatcactgtagttccttaagactcaggggcaaagcctcacttccttagcacccagtgaagaccacgcttactccctcactcaacctcttgctacttcccacctctcctgtccaacatctagtgtcactttccagaacataccaacagcttccccagttctgtgcctctgctcaggctgttccccctgcctggtccacttgtcctccttcttgtccggtcaaaatgcttcttatccttcaagacccagctctagagtcacctccaaccccttacccaccagccccctctccaagtctgtgtcccacaacccccctgctccctccagggcaccctccaccctctgggccacagttgtcaggagtcaggcagggcaggggccgggtggtgtcttctttgtgttcttgcactcagggcagagctcagcacagagcagacgctcaaaaaacatttaaaggatagaagcattgatttgtgggtcccccagtctggctccaggatgccagccagctgctcctagaagcaaacggacttttcctgggaaatcccagaggtgatgatcagtaatctctcccgtgactcgtagttcagctcttcctccatgagcctgactatcagtggaccttccagaaagagccccttttccttctctcacccacagcacagggcactgggaaaatgcccaatgagtcctgcctctgggttgtgctttggacttttcagtgtgtctcgcatccactcttcaacttgaatgttgcaacagccatgaaaaaagaaatgcaaagcgattcaggatgagagcaataccctactccaaagaaggcaacatagaagctcagagagatcaagcaatttgcccaagaccacacagctaggagtggaactcatggctgtccaagccccatgcctctgctgaaggtagagatgaattacagcaacaagtctagaaaggtgcctgccctatggtctgtgagtcttgcctaagaatgaaagaggagccagtgggttaaagatgaggtcaccaacaacggtggtgttggagtttaccactgataataagggtgcaaaatgtaaattactaatgtttattgagcctagtgcagtgcgtggggcattttgcacattgtctctgatccctatgacaaccctgagaggtagtggttttaactgccatgttacaggtgaggtcattgtggttcaaggacgttaagtaacttccccagcgtgacacggcttataagtaaggcagccaggatgtgaacccagtaggactatctggctgcaaagtccccacccccctcgccatctgtatcctccaatcacttcagtgctttgctgcatagaaggtaacggaaatcacgatgccacagactgtccaggaagacagaaactaggcagatgggctggccatggtctccaagccagactggaatctccaggtctggaatgatatcatttttctcttttaataaattaactcacccaccacacggctttgagaggctcaaagttgaccaactcccttgggagggccccggttgataaggaaggaacgtgaatcctcccatcacggaagcttcaaggaggtcaagggtccaacacttgagattgttagtgctgttggtggatactggccaaggaaatatcccagtggagcctcgagatgaagaacatgaggcccccgtttagaaccaaggatcagagggggctctgtaagacccaggggagtcaggtgcactggagcgcgggcatgcagaaaacagcctgagctccacctcggcttctccttgtcctggctggttgtccttaacccctgtctccttctggaccagtttttgtccttcccttgtgaccgctgaggggtaacagcctctttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgatgagacggtcgagcagggtgctgtgggtgatatggacagcagaagggggagccaggttccagctcaccaatactattgcacaccacctgtcctgcctcgcccttcaaagatgagctgttcccgccgccactccagctctggcttctgggctccgaggaggggtggggacggtggtgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgagctcttcaatattttagtgaaagctatagatgaggctccataggggataaagcacagacacaccttttcagagggcttgtggactctgggcagcctgtccatagacctctgtccccaactggcaagtcaggaaactccagattaaggagccccaatgtggttgaacagccaggtgcacagatgagtcaaccacacagccaggccagggagggccttcactcaagagcctacagccagttcacagccaagccagggctagcgccaggccacccataaactgatctgagactctgtttccctgtctccatgatgatgggatcaggcttgattgctggtttgtaggcttgttatgaatcaagtcacagggaagaggagctgatgggctggggggacgtcctctggccctcctgtctcttccccagatccactgggcccactcttatctgttctcttctgaaggaagggttttaaggcttcaaaaaaaaatgttttgaaagtccctgccctttccagctcctaccgtctcagccctgggagtgtaaagtgctgcagatagttagtaagtctttgagcaaaactgagaaagccagcctgagccttgacatgggagaaacctccgccatacatctccgaagaaacggccgcgtgtctcaggggagcgcaaacacccgtacccaggaaacaggacagcttctgccactgtcgcccttgggagccgtacgtggcatgacaaagaaatcccaggactccgcctgcccacctggccaccctctgtttacaccttccgcgtaaacgcccactgtttacatccaaaactcagacacaaaataaccacctcaagaagataaataatgataagaaataaatgttacgcgaggcaaatttattcacatggggcttcccaggccactttgtggtcagccgggagggacgtttttgccgtcccacgactccaacgggcagccgggcctacgcaaacatggaaatcttccaagagcctccctggcccccagggctcagagggtggcagagcggagagcgaaggtggccgcagccttcccggccccacagccagcctggctccagctgggcaggagtgcagagctcagctggaggcgagggggaagtgcccaggaggctgatgacatcactacccagcccttcaaagatgagctgttcccgccgccactccagctctggcttctgggctccgaggaggggtggggacggtggtgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgggaaaagttcccttccttccggagggaggcagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctggggggagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagacccaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccacctgtccctgcctcagttcccttttatgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaacctggagaggctagaaccaagaagggctagaacctggaggggctagaacctagagaagctaaaacctgagctagaagctggaggactagaacctggagggctggaatctgaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtgaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcaaaaaaaaaaaaaaaaaaaatgatagaccgtcaataatttgttaaatgctttttaaaatgaatgctttaagccgggtgcagtgcctcacatctgtaatcccagcactttggagccgagcgggtggattgtgtgaggtcaggagttcgagaccaacctggccaacatggcaaaacctcactctctaccaaaaatacaaaaattagccaggcatggtggcaggcacctgtgatcccagctactcaggaggctgagacaggagaatcgcttgaacccgggaggcaaggttgcagtgagccaagattacgccattgtactccagcctgggtgacagagagagactccgtctcaaaaaaaaaaaaaaaaaaaaaaaaattacgcttcaaacacatgatctctcaccactgttgaattttctttctatgagcccaggagggcctctcagagaggaaagctcctaggtcttcctttccctctgcaaactccctgccttgaaggttcagaaggactgtgcgtgctcgttgcatcctttgcaagtgtccaaaccctgatcccagctgtgcttaggggttcctgcaaaccttttccaggtgttaattacctcccacttcatttcctgtttaccaactcagctttttgttttagtgtgtttgaattccctgaactgaccgttgtctgatctccacctcccaactgaattaggggagctgggcttctggaaacccaggtgccgggtgttgcagagtggctgaaagctgggatgtggcagatccgtggctacattcatgcacacacacacacccacatacccacacatgcacacacacacacacacccgcactcacacacttggacatgcatagaccacagctttccacacccttcctagacaggggtcacttggtatcctggagagagtgtgaagtcctggaatggaaagaggggggattaagccccacctctagccatgggactgagacaagtcaccaccaacccatctgcgccttgtttacctcctctgtgaggcaagcacagagcccatgcctgcccccctggatgggagtgatgtgaaacttgaagggcggtcagagcaagggtcgggaatggaaggcccttgggaaaaaaggccctttcaactaggggcacagaggaggccctgggctgagaacttgacagcaccttgtaattggtaagccaagcccgaagggactggaaatactcagatgtgtctgtctcccttattaggttcaaagtccctcaagaccctgtctccatcacagtgctccagtccagacccctcctctgagctccagaccctgctggacccaaccagccctatggggtcgcatccccacctgcctggaattctccaaagaacctcccctttaacagttccagcctttaacagttccagtctaaacacatgacctttctcctctaaatcagccccccatctctgcctttgcaggagatggaagccatgacacctgcctcgcccctgtcctcaccccatccatgtccaatcaagcactaggcatgtcaggtttaccctctaaactcctctggaatccagtctctcagtctccatcatcccaggtcgaagctaatgggctaactggtccttgcttccactctacccccactgcagtcctgacttcctgagcagcagccagggcctaatcgatattcacaccaagcgccaacctgactgagatatcctcctgcaccatcatccctccaccctgtttagttctgctcaccctcagtgttctcatcaataatccactcccctcacaggcgcgtttgggaccccatgttctatgctctcacaggaccttttgcttgatttttcactgtacttaggtcagtttgcagttattaagtgactgagcaatgtctggcttctccagtagactgtcagctcctagccattgtatacctagcaccgctgtgtgggagcacgtgacaaacgtccagtgagtcagggactcagcagtctccatttctccgccctgctggagaatgcgtgtatttggcaatccccagcccctgtgccatctaaccatcttttcttctctgttcagcccaggtgtggcctcactcacatcccactctgagtccaaatgttctctccctggaagatatcaatgtttctgtctgttcgtgaggactccgtgcccaccacggcctctttcaggtgagtcaaagggattcctcagttcactagttaggggaggtgggcagacaccctggagaactccctggaaagctcaactctcatgccccggacaacagttgaaggaaccatggtgatgttaagcccaaagacaaaacctctcaggtgtccaagtccctgttggaatcttgggagcagagggaatgttctgtggtctagaggaagaggggctcagggaggagaagggcacattcctggttgttatatgtttctatctatcccagatgaacttggaagtgaagggaagagagttaaacattaaagtaaatacccagtggatcagacagcaatgtgccagattgccttggaaacaaaatatctccaacacatggctgacatttggtgggagatcagaacaccctaaagagagaatttaaggggagggggaggaggacctgagccagagtagaagcagaggatagggagatctgttcttggggacagcatttgcaagaaacaaggctgaggggtccactccaacctctccaccctgctgcaggtgctgcctatgatgaagatgagcagatggccatctcagctggggccacagtgcactggacctatagtttccaattccgcactcagcaggcatctttctgatgatccgatggcttctcagagccagggatgggccaggatccatccccttggctactgtcttgctgagaaatttataagcagcatctggtgctatactttggtctctagtgagttagctcatgaaagatgatagactctccaagccaggggtatgcaggaaatgggttttctgtagctacagaaatggggttgagggttggaccaagggactacccaggggaagtcttaccttcagaggactctggaaaggaggctgcaagttttcatgggtcaagaattcagagcccagtagagacagcttatctctgttccaagatgtctggggccttggttggaagattcaaaggctaggaaaccaggagccaccaaaagcgtaactggggccagaggatccactttcaaggtggcaagttggttccccccatgtggctgcttgagtatcctcacatggcggctcacatccttccaagtaagcaatgcaaaaggccaagaaagatgctgcaaagatgttatgacctagcctcagaaatcacacaccatccctgccaccattagtaagaagtccagcccacgtccaggagaagaggaagcagattcctccttttgaaatgaagaatatcaagtaattcggggggcatatgaaagccaccacacaccacagggatctttttagagcatacttcttataccatcactgtagttccttaagactcaggggcaaagcctcacttccttagcacccagtgaagaccacgcttactccctcactcaacctcttgctacttcccacctctcctgtccaacatctagtgtcactttccagaacataccaacagcttccccagttctgtgcctctgctcaggctgttccccctgcctggtccacttgtcctccttcttgtccggtcaaaatgcttcttatccttcaagacccagctctagagtcacctccaaccccttacccaccagccccctctccaagtctgtgtcccacaacccccctgctccctccagggcaccctccaccctctgggccacagttgtcaggagtcaggcagggcaggggccgggtggtgtcttctttgtgttcttgcactcagggcagagctcagcacagagcagacgctcaaaaaacatttaaaggatagaagcattgatttgtgggtcccccagtctggctccaggatgccagccagctgctcctagaagcaaacggacttttcctgggaaatcccagaggtgatgatcagtaatctctcccgtgactcgtagttcagctcttcctccatgagcctgactatcagtggaccttccagaaagagccccttttccttctctcacccacagcacagggcactgggaaaatgcccaatgagtcctgcctctgggttgtgctttggacttttcagtgtgtctcgcatccactcttcaacttgaatgttgcaacagccatgaaaaaagaaatgcaaagcgattcaggatgagagcaataccctactccaaagaaggcaacatagaagctcagagagatcaagcaatttgcccaagaccacacagctaggagtggaactcatggctgtccaagccccatgcctctgctgaaggtagagatgaattacagcaacaagtctagaaaggtgcctgccctatggtctgtgagtcttgcctaagaatgaaagaggagccagtgggttaaagatgaggtcaccaacaacggtggtgttggagtttaccactgataataagggtgcaaaatgtaaattactaatgtttattgagcctagtgcagtgcgtggggcattttgcacattgtctctgatccctatgacaaccctgagaggtagtggttttaactgccatgttacaggtgaggtcattgtggttcaaggacgttaagtaacttccccagcgtgacacggcttataagtaaggcagccaggatgtgaacccagtaggactatctggctgcaaagtccccacccccctcgccatctgtatcctccaatcacttcagtgctttgctgcatagaaggtaacggaaatcacgatgccacagactgtccaggaagacagaaactaggcagatgggctggccatggtctccaagccagactggaatctccaggtctggaatgatatcatttttctcttttaataaattaactcacccaccacacggctttgagaggctcaaagttgaccaactcccttgggagggccccggttgataaggaaggaacgtgaatcctcccatcacggaagcttcaaggaggtcaagggtccaacacttgagattgttagtgctgttggtggatactggccaaggaaatatcccagtggagcctcgagatgaagaacatgaggcccccgtttagaaccaaggatcagagggggctctgtaagacccaggggagtcaggtgcactggagcgcgggcatgcagaaaacagcctgagctccacctcggcttctccttgtcctggctggttgtccttaacccctgtctccttctggaccagtttttgtccttcccttgtgaccgctgaggggtaacagcctctttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgatgagacggtcgagcagggtgctgtgggtgatatggacagcagaagggggagccaggttccagctcaccaatactattgcacaccacctgtcctgcctcctgcagaaaacagcctgagctccacctcggcttctccttgccctggctggttgtccttaacccctgtctccttctggaccagtttttgtccttcccttgtgaccctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgncctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaagggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactggcactgccaccaccagaaagctgttcgacgagacggtcgagcagggtgctgtgggtgatatggacagcagaagggggagaccaaggttccagctcaaccaataactattgcacaaccacctgtccctgcctcagttccctcttctgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagatgatcctatcacaacctgagagtagtttttactccatttacaggtgaggtcattgtggttcaaggacgttaagtaacttccccagctcacacggcttataagtaaggcagccaggatgtgaacccagtaggactatctggctgcaaagtccccaccctccctcgccatctgtatcctccaatcatcttcagtgctttgctgatagaaggtacggaaatacgatgccacagactgtccaggaagacagaaactaggcagatgggctggccatggtctccaagccagactggaatctccaggtctggaatgatatcatttttctcttttaataaattaactcacccaccacacggctttgagaggctcaaaggtgaccaactcccttgggagggccccggttgataaggaaggaatgtgaatcctcccatcacggaagcttcaaggaggtcaagggtccaacacttgagattgttagtgctgttggtggatactgcagaatatccagtggagcctcagatgaagaacatgaggccccgtttagatccaaggatcagagggggctctgtaagacccaggggagtcaggtgcactggagcgcgggctgcagaaaacagcctgagctccacctcggcttctccttgccctggctggttgtccttaacccctgtctccttctggaccagtttttgtccttcccttgtgacctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagtgttgatgtctccggtaaaacaccggagactaattcctgccctgcccaattttcgagggagcatggctgtgaggatggggtgaactcacgcacagccaaggactccaaaatcacaacagcattactgttcttatttgctgccacacctgagccagcctgctccttcccaggagtggaggaggcctgggggagggagaggagtgactgagcttccctcccgtgtgttctccgtccctgccccagcaagacaacttagatctccaggagaactgccatccacgtttggtgcaatggctgagtgcacaagtgagttgttgccctgggtttctttaatctatcagctagaactttgaaggacaatttcttgcattaataaaggttaagccctgaggggtcccttgataacaacctggagaccaggattttatggctcccctcactgatggacaaggaggtctgtgccaaagaagaatcaataagcacatatgagcacttctgtatatcagtattgagcactgtaggcaatgttctctccctggaagatatcaatgtttctgtctgtttgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttatgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttgcccttcaaagatgagctgttcccgccgccactccagctctggcttctgggctccgaggaggggtggggacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgcccttcaaagatgagctgttcccgccgccactccagctctggcttctgggctccgaggaggggtggggacggtggtgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgagctcttcaatattttagtgaaagctatagatgaggctccataggggataaagcacagacacaccttttcagagggcttgtggactctgggcagcctgtccatagacctctgtccccaactggcaagtcaggaaactccagattaaggagccccaatgtggttgaacagccaggtgcacagatgagtcaaccacacagccaggccagggagggccttcactcaagagcctacagccagttcacagccaagccagggctagcgccaggccacccataaactgatctgagactctgtttccctgtctccatgatgatgggatcaggcttgattgctggtttgtaggcttgttatgaatcaagtcacagggaagaggagctgatgggctggggggacgtcctctggccctcctgtctcttccccagatccactgggcccactcttatctgttctcttctgaaggaagggttttaaggcttcaaaaaaaaatgttttgaaagtccctgccctttccagctcctaccgtctcagccctgggagtgtaaagtgctgcagatagttagtaagtctttgagcaaaactgagaaagccagcctgagccttgacatgggagaaacctccgccatacatctccgaagaaacggccgcgtgtctcaggggagcgcaaacacccgtacccaggaaacaggacagcttctgccactgtcgcccttgggagccgtacgtggcatgacaaagaaatcccaggactccgcctgcccacctggccaccctctgtttacaccttccgcgtaaacgcccactgtttacatccaaaactcagacacaaaataaccacctcaagaagataaataatgataagaaataaatgttacgcgaggcaaatttattcacatggggcttcccaggccactttgtggtcagccgggagggacgtttttgccgtcccacgactccaacgggcagccgggcctacgcaaacatggaaatcttccaagagcctccctggcccccagggctcagagggtggcagagcggagagcgaaggtggccgcagccttcccggccccacagccagcctggctccagctgggcaggagtgcagagctcagctggaggcgagggggaagtgcccaggaggctgatgacatcactacccagcccttcaaagatgagctgttcccgccgccactccagctctggcttctgggctccgaggaggggtggggacggtggtgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgggaaaagttcccttccttccggagggaggcagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctggggggagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagacccaagaaagagaaggagccatctccatcttgaaggaactcaaagactcaagtgggaacgactgggcactgccaccaccagaaagctgttcgacgagacggtcgagcagggtgctgtgggtgatatggacagcagaagggggagaccaaggttccagctcaaccaataactattgcacaaccacctgtccctgcctcagttcccttttatgtaacatgaagtcgttgtgagggttaaaggcagtaacaggtataaagtacttagaaaagcaaagggtgctacgtacatgtgaggcatcattacgcagacgtaactgggatatgtttactataaggaaaagacactgaggtctagaaatagctccgtggagcagaatcagtattgggagccggtggcggtgtgaagcaccagtgtctggcacacagtaggtgctcattggctcccttccacctgtcattcccaccaccctgaggccccaaccgccacacacacaggagcatttggagagaaggccatgtcttcaaagtctgatttgtgatgaggcagaggaagatatttctaatcggtcttgcccagaggatcacagtgctgagaccccccaccaccagccggtacctgggaagggggagagtgcaggcctgctcagggactgttcctgtctcagcaaccaagggattgttcctgtcaatcaatggtttattggaaggtggcccagtatgagccctagaagagtgtgaaaaggaatggcaatggtgttcaccatcggcagtgccagggcagcactcattcacttgataaatgaatatttattagctggttggagagctagaacctggagagctagaacctggagaactagaacctggagggctagaacctggagaggctagaaccaagaagggctagaacctggaggggctagaacctagagaagctaaaacctgagctagaagctggaggactagaacctggagggctggaatctgaagggctagaacctggagggctggaatctggagagctagaacctggagggctagaacctggagggctagaacctagaagggctagaacctggagggctggaatctggagagctagaacctggagggctagaacctggagggctagaacctagaagggctagaacctggagggctagaacctggcaggttagaacctagaagggctagaacctggagagccagaacctggagggctagaacctggaagggctagaacctgtagagctagaacatggagagctagaacccggcaggctagaacctggcaagctagaacctggagggaatgaacctggagggctagaacctggagaatgagaaaaatttacatggcaaagagcccataaatcctgaccaatccaactctgaattttaaagcaaaagcgtgaaaaaaaagattccctccttacccccaacccactcttttttcccaccacccactctcctctgcctcagtaagtatctggaggaagaaaacaggtgaaagaagaagtaaaaaccatttagtattagtattagaatgaagtcaaactgtgccacacatggtgaatgaaaaaaaaaaaaaagaggctgtgttttgtcacacagggcagtcattcagcaccagagcacgtgatggtctgagactctcttaggagcagagctctgccgcaatggccatgtggggatccacacctggtctgaggggcaactgagtctgcgggagaagagcggccctatgcatggtgtagatgccctgataaagaacatctgtcctgtgaaagactcaatgagctgttatgttgtaaacaggaagcatttcacatccaaacgagaaaatcatgtaaacatgtgtcttttctgtagagcataataaatggatgaggtttttgcaaaaaaaaaaaaaaaaaaaatgatagaccgtcaataatttgttaaatgctttttaaaatgaatgctttaagccgggtgcagtgcctcacatctgtaatcccagcactttggagccgagcgggtggattgtgtgaggtcaggagttcgagaccaacctggccaacatggcaaaacctcactctctaccaaaaatacaaaaattagccaggcatggtggcaggcacctgtgatcccagctactcaggaggctgagacaggagaatcgcttgaacccgggaggcaaggttgcagtgagccaagattacgccattgtactccagcctgggtgacagagagagactccgtctcaaaaaaaaaaaaaaaaaaaaaaaaattacgcttcaaacacatgatctctcaccactgttgaattttctttctatgagcccaggagggcctctcagagaggaaagctcctaggtcttcctttccctctgcaaactccctgccttgaaggttcagaaggactgtgcgtgctcgttgcatcctttgcaagtgtccaaaccctgatcccagctgtgcttaggggttcctgcaaaccttttccaggtgttaattacctcccacttcatttcctgtttaccaactcagctttttgttttagtgtgtttgaattccctgaactgaccgttgtctgatctccacctcccaactgaattaggggagctgggcttctggaaacccaggtgccgggtgttgcagagtggctgaaagctgggatgtggcagatccgtggctacattcatgcacacacacacacccacatacccacacatgcacacacacacacacacccgcactcacacacttggacatgcatagaccacagctttccacacccttcctagacaggggtcacttggtatcctggagagagtgtgaagtcctggaatggaaagaggggggattaagccccacctctagccatgggactgagacaagtcaccaccaacccatctgcgccttgtttacctcctctgtgaggcaagcacagagcccatgcctgcccccctggatgggagtgatgtgaaacttgaagggcggtcagagcaagggtcgggaatggaaggcccttgggaaaaaaggccctttcaactaggggcacagaggaggccctgggctgagaacttgacagcaccttgtaattggtaagccaagcccgaagggactggaaatactcagatgtgtctgtctcccttattaggttcaaagtccctcaagaccctgtctccatcacagtgctccagtccagacccctcctctgagctccagaccctgctggacccaaccagccctatggggtcgcatccccacctgcctggaattctccaaagaacctcccctttaacagttccagcctttaacagttccagtctaaacacatgacctttctcctctaaatcagccccccatctctgcctttgcaggagatggaagccatgacacctgcctcgcccctgtcctcaccccatccatgtccaatcaagcactaggcatgtcaggtttaccctctaaactcctctggaatccagtctctcagtctccatcatcccaggtcgaagctaatgggctaactggtccttgcttccactctacccccactgcagtcctgacttcctgagcagcagccagggcctaatcgatattcacaccaagcgccaacctgactgagatatcctcctgcaccatcatccctccaccctgtttagttctgctcaccctcagtgttctcatcaataatccactcccctcacaggcgcgtttgggaccccatgttctatgctctcacaggaccttttgcttgatttttcactgtacttaggtcagtttgcagttattaagtgactgagcaatgtctggcttctccagtagactgtcagctcctagccattgtatacctagcaccgctgtgtgggagcacgtgacaaacgtccagtgagtcagggactcagcagtctccatttctccgccctgctggagaatgcgtgtatttggcaatccccagcccctgtgccatctaaccatcttttcttctctgttcagcccaggtgtggcctcactcacatcccactctgagtccaaatgttctctccctggaagatatcaatgtttctgtctgttcgtgaggactccgtgcccaccacggcctctttcaggtgagtcaaagggattcctcagttcactagttaggggaggtgggcagacaccctggagaactccctggaaagctcaactctcatgccccggacaacagttgaaggaaccatggtgatgttaagcccaaagacaaaacctctcaggtgtccaagtccctgttggaatcttgggagcagagggaatgttctgtggtctagaggaagaggggctcagggaggagaagggcacattcctggttgttatatgtttctatctatcccagatgaacttggaagtgaagggaagagagttaaacattaaagtaaatacccagtggatcagacagcaatgtgccagattgccttggaaacaaaatatctccaacacatggctgacatttggtgggagatcagaacaccctaaagagagaatttaaggggagggggaggaggacctgagccagagtagaagcagaggatagggagatctgttcttggggacagcatttgcaagaaacaaggctgaggggtccactccaacctctccaccctgctgcaggtgctgcctatgatgaagatgagcagatggccatctcagctggggccacagtgcactggacctatagtttccaattccgcactcagcaggcatctttctgatgatccgatggcttctcagagccagggatgggccaggatccatccccttggctactgtcttgctgagaaatttataagcagcatctggtgctatactttggtctctagtgagttagctcatgaaagatgatagactctccaagccaggggtatgcaggaaatgggttttctgtagctacagaaatggggttgagggttggaccaagggactacccaggggaagtcttaccttcagaggactctggaaaggaggctgcaagttttcatgggtcaagaattcagagcccagtagagacagcttatctctgttccaagatgtctggggccttggttggaagattcaaaggctaggaaaccaggagccaccaaaagcgtaactggggccagaggatccactttcaaggtggcaagttggttccccccatgtggctgcttgagtatcctcacatggcggctcacatccttccaagtaagcaatgcaaaaggccaagaaagatgctgcaaagatgttatgacctagcctcagaaatcacacaccatccctgccaccattagtaagaagtccagcccacgtccaggagaagaggaagcagattcctccttttgaaatgaagaatatcaagtaattcggggggcatatgaaagccaccacacaccacagggatctttttagagcatacttcttataccatcactgtagttccttaagactcaggggcaaagcctcacttccttagcacccagtgaagaccacgcttactccctcactcaacctcttgctacttcccacctctcctgtccaacatctagtgtcactttccagaacataccaacagcttccccagttctgtgcctctgctcaggctgttccccctgcctggtccacttgtcctccttcttgtccggtcaaaatgcttcttatccttcaagacccagctctagagtcacctccaaccccttacccaccagccccctctccaagtctgtgtcccacaacccccctgctccctccagggcaccctccaccctctgggccacagttgtcaggagtcaggcagggcaggggccgggtggtgtcttctttgtgttcttgcactcagggcagagctcagcacagagcagacgctcaaaaaacatttaaaggatagaagcattgatttgtgggtcccccagtctggctccaggatgccagccagctgctcctagaagcaaacggacttttcctgggaaatcccagaggtgatgatcagtaatctctcccgtgactcgtagttcagctcttcctccatgagcctgactatcagtggaccttccagaaagagccccttttccttctctcacccacagcacagggcactgggaaaatgcccaatgagtcctgcctctgggttgtgctttggacttttcagtgtgtctcgcatccactcttcaacttgaatgttgcaacagccatgaaaaaagaaatgcaaagcgattcaggatgagagcaataccctactccaaagaaggcaacatagaagctcagagagatcaagcaatttgcccaagaccacacagctaggagtggaactcatggctgtccaagccccatgcctctgctgaaggtagagatgaattacagcaacaagtctagaaaggtgcctgccctatggtctgtgagtcttgcctaagaatgaaagaggagccagtgggttaaagatgaggtcaccaacaacggtggtgttggagtttaccactgataataagggtgcaaaatgtaaattactaatgtttattgagcctagtgcagtgcgtggggcattttgcacattgtctctgatccctatgacaaccctgagaggtagtggttttaactgccatgttacaggtgaggtcattgtggttcaaggacgttaagtaacttccccagcgtgacacggcttataagtaaggcagccaggatgtgaacccagtaggactatctggctgcaaagtccccacccccctcgccatctgtatcctccaatcacttcagtgctttgctgcatagaaggtaacggaaatcacgatgccacagactgtccaggaagacagaaactaggcagatgggctggccatggtctccaagccagactggaatctccaggtctggaatgatatcatttttctcttttaataaattaactcacccaccacacggctttgagaggctcaaagttgaccaactcccttgggagggccccggttgataaggaaggaacgtgaatcctcccatcacggaagcttcaaggaggtcaagggtccaacacttgagattgttagtgctgttggtggatactggccaaggaaatatcccagtggagcctcgagatgaagaacatgaggcccccgtttagaaccaaggatcagagggggctctgtaagacccaggggagtcaggtgcactggagcgcgggcatgcagaaaacagcctgagctccacctcggcttctccttgtcctggctggttgtccttaacccctgtctccttctggaccagtttttgtccttcccttgtgaccgctgaggggtaacagcctctttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagttgatgtctccggtaaaacaccggagactaattcctgccctgcccaattttgcagggagcatggctgtgaggatggggtgaactcacgcacagccaaggactccaaaatcacaacagcattactgttcttatttgctgccacacctgagccagcctgctccttcccaggagtggaggaggcctgggggcagggagaggagtgactgagcttccctcccgtgtgttctccgtccctgccccagcaagacaacttagatctccaggagaactgccatccagctttggtgcaatggctgagtgcacaagtgagttgttgccctgggtttctttaatctattcagctagaactttgaaggacaatttcttgcattaataaaggttaagccctgaggggtccctgataacaacctggagaccaggattttatggctcccctcactgatggacaaggaggtctgtgccaaagaagaatccaataagcacatattgagcacttgctgtatatgcagtattgagcactgtaggcaagagggaagaaagagaaggagccatctccatcttgaaggaactcaaagactcaagtgggaacgactgggcactgccaccaccagaaagctgttcgatgagacggtcgagcagggtgctgtgggtgatatggacagcagaagggggagccaggttccagctcaccaatactattgcacaccacctgtcctgcctctgatcctatcacaacctgagagtagtttttactccatttacaggtgaggtcattgtggttcaaggacgttaagtaacttccccagctcacacggcttataagtaaggcagccaggatgtgaacccagtaggactatctggctgcaaagtccccaccctccctcgccatctgtatcctccaatcatcttcagtgctttgctgatagaaggtacggaaatacgatgccacagactgtccaggaagacagaaactaggcagatgggctggccatggtctccaagccagactggaatctccaggtctggaatgatatcatttttctcttttaataaattaactcacccaccacacggctttgagaggctcaaaggtgaccaactcccttgggagggccccggttgataaggaaggaatgtgaatcctcccatcacggaagcttcaaggaggtcaagggtccaacacttgagattgttagtgctgttggtggatactgcagaatatccagtggagcctcagatgaagaacatgaggccccgtttagatccaaggatcagagggggctctgtaagacccaggggagtcaggtgcactggagcgcgggctgcagaaaacagcctgagctccacctcggcttctccttgccctggctggttgtccttaacccctgtctccttctggaccagtttttgtccttcccttgtgacctgaggggtaacagcctcttttccactttctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttttcagcatgggcccaggaatgccaaggagacatctatgcacgaccttgggaaatgagtgttgatgtctccggtaaaacaccggagactaattcctgccctgcccaattttcgagggagcatggctgtgaggatggggtgaactcacgcacagccaaggactccaaaatcacaacagcattactgttcttatttgctgccacacctgagccagcctgctccttcccaggagtggaggaggcctgggggagggagaggagtgactgagcttccctcccgtgtgttctccgtccctgccccagcaagacaacttagatctccaggagaactgccatccacgtttggtgcaatggctgagtgcacaagtgagttgttgccctgggtttctttaatctatcagctagaactttgaaggacaatttcttgcattaataaaggttaagccctgaggggtcccttgataacaacctggagaccaggattttatggctcccctcactgatggacaaggaggtctgtgccaaagaagaatcaataagcacatatgagcacttctgtatatcagtattgagcactgtaggcaatgttctctccctggaagatatcaatgtttctgtctgtttgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttatgttctctccctggaagatatcaatgtttctgtctgttcgtgaggactccgtgcccaccacggcctctttcagcgccgacatgctcaatgtcaccttgcaagggcccactcttaacgggacctttgcccagagcaaatgcccccaagtggagtggctgggctggctcaacaccatccagccccccttcctctgggtgctgttcgtgctggccaccctagagaacatctttgtcctcagcgtcttctgcctgcacaagagcagctgcacggtggcagagatctacctggggaacctggccgcagcagacctgatcctggcctgcgggctgcccttctgggccatcaccatctccaacaacttcgactggctctttggggagacgctctgccgcgtggtgaatgccattatctccatgaacctgtacagcagcatctgtttcctgatgctggtgagcatcgaccgctacctggccctggtgaaaaccatgtccatgggccggatgcgcggcgtgcgctgggccaagctctacagcttggtgatctgggggtgtacgctgctcctgagctcacccatgctggtgttccggaccatgaaggagtacagcgatgagggccacaacgtcaccgcttgtgtcatcagctacccatccctcatctgggaagtgttcaccaacatgctcctgaatgtcgtgggcttcctgctgcccctgagtgtcatcaccttctgcacgatgcagatcatgcaggtgctgcggaacaacgagatgcagaagttcaaggagatccagacggagaggagggccacggtgctagtcctggttgtgctgctgctattcatcatctgctggctgcccttccagatcagcaccttcctggatacgctgcatcgcctcggcatcctctccagctgccaggacgagcgcatcatcgatgtaatcacacagatcgcctccttcatggcctacagcaacagctgcctcaacccactggtgtacgtgatcgtgggcaagcgcttccgaaagaagtcttgggaggtgtaccagggagtgtgccagaaagggggctgcaggtcagaacccattcagatggagaactccatgggcacactgcggacctccatctccgtggaacgccagattcacaaactgcaggactgggcagggagcagacagtgagcaaacgccagcagggctgctgtgaatttgtgtaaggattgagggacagttgcttgcccttcaaagatgagctgttcccgccgccactccagctctggcttctgggctccgaggaggggtggggacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgcccttcaaagatgagctgttcccgccgccactccagctctggcttctgggctccgaggaggggtggggacggtggtgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagttgagctcttcaatattttagtgaaagctatagatgaggctccataggggataaagcacagacacaccttttcagagggcttgtggactctgggcagcctgtccatagacctctgtccccaactggcaagtcaggaaactccagattaaggagccccaatgtggttgaacagccaggtgcacagatgagtcaaccacacagccaggccagggagggccttcactcaagagcctacagccagttcacagccaagccagggctagcgccaggccacccataaactgatctgagactctgtttccctgtctccatgatgatgggatcaggcttgattgctggtttgtaggcttgttatgaatcaagtcacagggaagaggagctgatgggctggggggacgtcctctggccctcctgtctcttccccagatccactgggcccactcttatctgttctcttctgaaggaagggttttaaggcttcaaaaaaaaatgttttgaaagtccctgccctttccagctcctaccgtctcagccctgggagtgtaaagtgctgcagatagttagtaagtctttgagcaaaactgagaaagccagcctgagccttgacatgggagaaacctccgccatacatctccgaagaaacggccgcgtgtctcaggggagcgcaaacacccgtacccaggaaacaggacagcttctgccactgtcgcccttgggagccgtacgtggcatgacaaagaaatcccaggactccgcctgcccacctggccaccctctgtttacaccttccgcgtaaacgcccactgtttacatccaaaactcagacacaaaataaccacctcaagaagataaataatgataagaaataaatgttacgcgaggcaaatttattcacatggggcttcccaggccactttgtggtcagccgggagggacgtttttgccgtcccacgactccaacgggcagccgggcctacgcaaacatggaaatcttccaagagcctccctggcccccagggctcagagggtggcagagcggagagcgaaggtggccgcagccttcccggccccacagccagcctggctccagctgggcaggagtgcagagctcagctggaggcgagggggaagtgcccaggaggctgatgacatcactacccagcccttcaaagatgagctgttcccgccgccactccagctctggcttctgggctccgaggaggggtggggacggtggtgacggtggggacatcaggctgccccgcagtaccagggagcgactgaagtgcccatgccgcttgctccggagaaggtgggtgccgggcaggggctgctccagccgcctcacctctgctgggaggacaaactgtcccagcacagagggagggagggagggcaggcagcggggagaagtttccctgtggtcgtggggagtt

SEQ ID NO: 3019 - DNA, 19 bp; single-stranded, linear
cccggccccgcctcgtgcc

SEQ ID NO: 3020 - DNA, 18 bp; single-stranded, linear
cgtccbtgccgcgggccc

SEQ ID NO: 3021 - DNA, 28 bp; single-stranded, linear
gccccgctgcttgggctgctctgccggg

SEQ ID NO: 3022 - DNA, 21 bp; single-stranded, linear
tctgtgctcctctcgcctggg

SEQ ID NO: 3023 - DNA, 21 bp; single-stranded, linear
tggtggggtgggtcttggtgg

SEQ ID NO: 3024 - DNA, 17 bp; single-stranded, linear
ctgtccctggtcctgtg

SEQ ID NO: 3025 - DNA, 14 bp; single-stranded, linear
ggtcccgcttcttc

SEQ ID NO: 3026 - DNA, 19 bp; single-stranded, linear
ggggttgttgttggtctgg

SEQ ID NO: 3027 - DNA, 14 bp; single-stranded, linear
tgtcctctttctgc

SEQ ID NO: 3028 - DNA, 14 bp; single-stranded, linear
gcctcgggcctccc

SEQ ID NO: 3029 - DNA, 15 bp; single-stranded, linear
ggctggggtctgcgt

SEQ ID NO: 3030 - DNA, 24 bp; single-stranded, linear
ggccgggggtcggtgggtccgctg

SEQ ID NO: 3031 - DNA, 22 bp; single-stranded, linear
gggctggggtgctggcttgggg

SEQ ID NO: 3032 - DNA, 18 bp; single-stranded, linear
ggggctggggcctgggcc

SEQ ID NO: 3033 - DNA, 20 bp; single-stranded, linear
gcctgggtgggcttgggggc

SEQ ID NO: 3034 - DNA, 20 bp; single-stranded, linear
gctgggtctgtgctgttgcc

SEQ ID NO: 3035 - DNA, 15 bp; single-stranded, linear
gttgtgtggggggcc

SEQ ID NO: 3036 - DNA, 27 bp; single-stranded, linear
gctgggtcggggggcctctgggctgtc

SEQ ID NO: 3037 - DNA, 14 bp; single-stranded, linear
gccccggggccccc

SEQ ID NO: 3038 - DNA, 14 bp; single-stranded, linear
tggctcccccctcc

SEQ ID NO: 3039 - DNA, 14 bp; single-stranded, linear
gctcccccctttcc

SEQ ID NO: 3040 - DNA, 16 bp; single-stranded, linear
cggacgaagacagaga

SEQ ID NO: 3041 - DNA, 14 bp; single-stranded, linear
ggctttgtgggctc

SEQ ID NO: 3042 - DNA, 14 bp; single-stranded, linear
gcctgctctccccc

SEQ ID NO: 3043 - DNA, 19 bp; single-stranded, linear
cccggccccgccbcgbbcc

SEQ ID NO: 3044 - DNA, 15 bp; single-stranded, linear
cccggccccgccbcg

SEQ ID NO: 3045 - DNA, 19 bp; single-stranded, linear
cccggccccgccbcgbbcc

SEQ ID NO: 3046 - DNA, 15 bp; single-stranded, linear
cccggccccgccbcg

SEQ ID NO: 3046 - DNA, 17 bp; single-stranded, linear
cccgbccccgcctcbbg

SEQ ID NO: 3047 - DNA, 14 bp; single-stranded, linear
cccgbccccgcctc

SEQ ID NO: 3048 - DNA, 13 bp; single-stranded, linear
ccggccccgcctc

SEQ ID NO: 3049 - DNA, 19 bp; single-stranded, linear
cccgbbcccgcbtbgtgcc

SEQ ID NO: 3050 - DNA, 13 bp; single-stranded, linear
cccgcbtbgtgcc

SEQ ID NO: 3051 - DNA, 19 bp; single-stranded, linear
cccggbcccbccbbgtgcc

SEQ ID NO: 3052 - DNA, 18 bp; single-stranded, linear
cbgbbcccgcctcgtgcc

SEQ ID NO: 3053 - DNA, 13 bp; single-stranded, linear
cccgcctcgtgcc

SEQ ID NO: 3054 - DNA, 18 bp; single-stranded, linear
ccggcbccgcctcbtgcc

SEQ ID NO: 3055 - DNA, 18 bp; single-stranded, linear
ccggccccgccbcbtgcc

SEQ ID NO: 3056 - DNA, 15 bp; single-stranded, linear
cccgbccccgbctcg

SEQ ID NO: 3057 - DNA, 15 bp; single-stranded, linear
cccggccbcgbctcg

SEQ ID NO: 3058 - DNA, 15 bp; single-stranded, linear
cccggcccbgcctbg

SEQ ID NO: 3059 - DNA, 19 bp; single-stranded, linear
cccggcbcbgbctcgtbcc

SEQ ID NO: 3060 - DNA, 15 bp; single-stranded, linear
cccggccccgccbcg

SEQ ID NO: 3061 - DNA, 15 bp; single-stranded, linear
cccggccccgccbcg

SEQ ID NO: 3062 - DNA, 14 bp; single-stranded, linear
tccbtgccgcgggc

SEQ ID NO: 3063 - DNA, 15 bp; single-stranded, linear
tccbtgccbcgggcc

SEQ ID NO: 3064 - DNA, 15 bp; single-stranded, linear
tccbtgccbcgggcc

SEQ ID NO: 3065 - DNA, 15 bp; single-stranded, linear
tccbtgccbcbggcc

SEQ ID NO: 3066 - DNA, 13 bp; single-stranded, linear
gtccbtgbcgcgg

SEQ ID NO: 3067 - DNA, 13 bp; single-stranded, linear
tccbtgbcgcggg

SEQ ID NO: 3068 - DNA, 21 bp; single-stranded, linear
tctgbgctcctctbbcctggg

SEQ ID NO: 3069 - DNA, 20 bp; single-stranded, linear
ctgtgcbcctbbcbcctggg

SEQ ID NO: 3070 - DNA, 19 bp; single-stranded, linear
tgtgbtccbctbgbctggg

SEQ ID NO: 3071 - DNA, 19 bp; single-stranded, linear
tctgtbctcbbctcbcctg

SEQ ID NO: 3072 - DNA, 17 bp; single-stranded, linear
tgctcctcbcbbctggg

SEQ ID NO: 3073 - DNA, 14 bp; single-stranded, linear
ctcctctbgcctgg

SEQ ID NO: 3074 - DNA, 18 bp; single-stranded, linear
gtgctccbbtcbbctggg

SEQ ID NO: 3075 - DNA, 18 bp; single-stranded, linear
gtgcbccbbtcbcctggg

SEQ ID NO: 3076 - DNA, 18 bp; single-stranded, linear
tctgtgcbcctctbgbct

SEQ ID NO: 3077 - DNA, 16 bp; single-stranded, linear
tbbtcctbbcbcctgg

SEQ ID NO: 3078 - DNA, 19 bp; single-stranded, linear
tgtgctbbtcbcbcbtggg

SEQ ID NO: 3079 - DNA, 16 bp; single-stranded, linear
gtgcbccbctcbcctg

SEQ ID NO: 3080 - DNA, 13 bp; single-stranded, linear
ctgtgcbcctctc

SEQ ID NO: 3081 - DNA, 18 bp; single-stranded, linear
cbgtgcbccbctcbcctg

SEQ ID NO: 3082 - DNA, 16 bp; single-stranded, linear
gtgcbccbctcbcctg

SEQ ID NO: 3083 - DNA, 15 bp; single-stranded, linear
cbcctctcbcctggg

SEQ ID NO: 3084 - DNA, 13 bp; single-stranded, linear
cctctcbcctggg

SEQ ID NO: 3085 - DNA, 13 bp; single-stranded, linear
gctccbctcgcct

SEQ ID NO: 3086 - DNA, 13 bp; single-stranded, linear
tgctcctcbcgcc

SEQ ID NO: 3087 - DNA, 13 bp; single-stranded, linear
gttgttgbtctgg

SEQ ID NO: 3088 - DNA, 18 bp; single-stranded, linear
ggttgbbbttggtcttgg

SEQ ID NO: 3089 - DNA, 16 bp; single-stranded, linear
ggttgttgbtgbtctg

SEQ ID NO: 3090 - DNA, 18 bp; single-stranded, linear
gggttbbbgttgbtctgg

SEQ ID NO: 3091 - DNA, 18 bp; single-stranded, linear
gggttbbbgttgbtctgg

SEQ ID NO: 3092 - DNA, 15 bp; single-stranded, linear
ttgttgtbgbtctgg

SEQ ID NO: 3093 - DNA, 18 bp; single-stranded, linear
gggtbgbbgbgtccgctg

SEQ ID NO: 3094 - DNA, 18 bp; single-stranded, linear
gggtcbgbggbtcbgctg

SEQ ID NO: 3095 - DNA, 13 bp; single-stranded, linear
gggtbggtgggtc

SEQ ID NO: 3096 - DNA, 16 bp; single-stranded, linear
gggtcggbgggtcbgc

SEQ ID NO: 3097 - DNA, 13 bp; single-stranded, linear
cctgggtgggctt

SEQ ID NO: 3098 - DNA, 13 bp; single-stranded, linear
gggtgggcttggg

SEQ ID NO: 3099 - DNA, 16 bp; single-stranded, linear
cctgggtgggbbtggg

SEQ ID NO: 3100 - DNA, 16 bp; single-stranded, linear
cctggbtgggcbtggg

SEQ ID NO: 3101 - DNA, 17 bp; single-stranded, linear
gcctgbgtgbbcttggg

SEQ ID NO: 3102 - DNA, 17 bp; single-stranded, linear
cccavgvccvcccaggc

SEQ ID NO: 3103 - DNA, 13 bp; single-stranded, linear
agcccacccaggc

SEQ ID NO: 3104 - DNA, 14 bp; single-stranded, linear
bcctgggtgggctb

SEQ ID NO: 3105 - DNA, 12 bp; single-stranded, linear
ggtgggcttggg

SEQ ID NO: 3106 - DNA, 16 bp; single-stranded, linear
ccbbggtgggcttggg

SEQ ID NO: 3107 - DNA, 15 bp; single-stranded, linear
ctgggtgggbbtggg

SEQ ID NO: 3108 - DNA, 15 bp; single-stranded, linear
ccbgggtgggcttgg

SEQ ID NO: 3109 - DNA, 12 bp; single-stranded, linear
gggtgggcttgg

SEQ ID NO: 3110 - DNA, 16 bp; single-stranded, linear
cctgbgtgbgcbtggg
